(12) United States Patent
Zhang

(10) Patent No.: US 12,357,672 B2
(45) Date of Patent: Jul. 15, 2025

(54) PROTEIN MOLECULE OF INTERLEUKINS 12a AND b COMBINED WITH ADDITIONAL FACTORS

(71) Applicant: NINGBO INNOVATIVE MECHANISM BIOSCIENCE LLC, Ningbo (CN)

(72) Inventor: Jinyu Zhang, Chongqing (CN)

(73) Assignee: NINGBO INNOVATIVE MECHANISM BIOSCIENCE LLC, Ningbo (CN)

( * ) Notice: Subject to any disclaimer, the term of this patent is extended or adjusted under 35 U.S.C. 154(b) by 715 days.

(21) Appl. No.: 17/606,855

(22) PCT Filed: Apr. 24, 2020

(86) PCT No.: PCT/CN2020/086751
§ 371 (c)(1),
(2) Date: Oct. 27, 2021

(87) PCT Pub. No.: WO2020/221135
PCT Pub. Date: Nov. 5, 2020

(65) Prior Publication Data
US 2022/0211803 A1    Jul. 7, 2022

(30) Foreign Application Priority Data
Apr. 28, 2019  (CN) .......................... 201910348357.1

(51) Int. Cl.
| A61K 38/16 | (2006.01) |
| C07K 14/535 | (2006.01) |
| C07K 14/54 | (2006.01) |
| C07K 14/55 | (2006.01) |
| C07K 19/00 | (2006.01) |
| C12N 15/09 | (2006.01) |

(52) U.S. Cl.
CPC ............ *A61K 38/16* (2013.01); *C07K 14/535* (2013.01); *C07K 14/5418* (2013.01); *C07K 14/5434* (2013.01); *C07K 14/5443* (2013.01); *C07K 14/55* (2013.01); *C07K 19/00* (2013.01); *C12N 15/09* (2013.01); *C07K 2319/02* (2013.01)

(58) Field of Classification Search
CPC ................................................. C07K 14/5434
See application file for complete search history.

(56) References Cited

U.S. PATENT DOCUMENTS

| 5,891,680 A | 4/1999 | Lieschke et al. |
| 6,617,135 B1 | 9/2003 | Gillies et al. |
| 7,141,651 B2 | 11/2006 | Gillies et al. |
| 7,582,288 B2 | 9/2009 | Gillies et al. |
| 11,795,203 B2 * | 10/2023 | Zhang ................. A61P 35/00 |
| 2004/0072299 A1 | 4/2004 | Gillies et al. |
| 2007/0258944 A1 | 11/2007 | Gillies et al. |
| 2017/0166620 A1 | 6/2017 | Strittmatter et al. |
| 2020/0199189 A1 | 6/2020 | Zhang |

FOREIGN PATENT DOCUMENTS

| CN | 1382158 A | 11/2002 |
| EP | 3 607 965 A1 | 2/2020 |
| WO | WO 96/24676 A1 | 8/1996 |
| WO | WO 01/10912 A1 | 2/2001 |
| WO | WO 2015/124297 A1 | 8/2015 |
| WO | WO 2018/184484 A1 | 10/2018 |

OTHER PUBLICATIONS

Skolnick et al (Trends Biotechnol. Jan. 2000;18(1):34-9) (Year: 2000).*
Burgess et al. (J. Cell Biol. 111:2129-2138, 1990) (Year: 1990).*
Lazar et al. (Mol. Cell. Biol., 8:1247-1252, 1988) (Year: 1988).*
Miosge (Proc Natl Acad Sci U S A. Sep. 15, 2015;112(37):E5189-98) (Year: 2015).*
Bork (Genome Research, 2000, 10:398-400) (Year: 2000).*
Kulmanov et al (Bioinformatics, 34(4), 2018, 660-668) (Year: 2018).*
Hombach et al (OncoImmunology 2013; 2:e23205) (Year: 2013).*
Wen et al (J Transl Med (2016) 14:41) (Year: 2016).*
Gafner et al (Int. J. Cancer: 119, 2205-2212 (2006)) (Year: 2006).*
Extended European Search Report issued Jan. 26, 2023, in corresponding European Patent Application No. 20798256.2, 11 pages.
Stephen Gillies et al., "Bi-functional cytokine fusion proteins for gene therapy and antibody-targeted treatment of cancer", Cancer Immunology Immunotherapy, vol. 51, No. 8, Oct. 1, 2002, pp. 449-460, XP055735628.
Roberto De Luca et al., "Potency-matched Dual Cytokine-Antibody Fusion Proteins for Cancer Therapy", Molecular Cancer Therapeutics, vol. 16, No. 11, Nov. 1, 2017, pp. 2442-2451, XP055436538.
Lode H. N. et al., "Tumor-targeted IL-2 amplifies T cell-mediated immune response induced by gene therapy with single-chain IL-12", Proceedings of the National Academy of Sciences, National Academy of Sciences, vol. 96, No. 15, Jul. 20, 1999, pp. 8591-8596, XP002224792.
Extended European Search Report issued on Jan. 26, 2023 in European patent Application No. 20798256.2, 11 pages.
International Search Report issued on Jul. 29, 2020 in PCT/CN2020/086751 filed on Apr. 24, 2020, 3 pages.
Wen, Q. et al., "Fusion cytokine IL-2-GMCSF enhances anticancer immune responses through promoting cell-cell interactions," Journal of Translational Medicine, vol. 14, No. 41, 2016, pp. 1-13.

* cited by examiner

*Primary Examiner* — Brian Gangle
*Assistant Examiner* — Andrea K McCollum
(74) *Attorney, Agent, or Firm* — Merchant & Gould P.C.; Daniel J. Pereira

(57) ABSTRACT

A protein molecule that includes interleukin 12a (IL12a), interleukin 12b (IL12b), a first factor and a second factor located in the same polypeptide chain that can be used for treating tumors.

20 Claims, 17 Drawing Sheets
Specification includes a Sequence Listing.

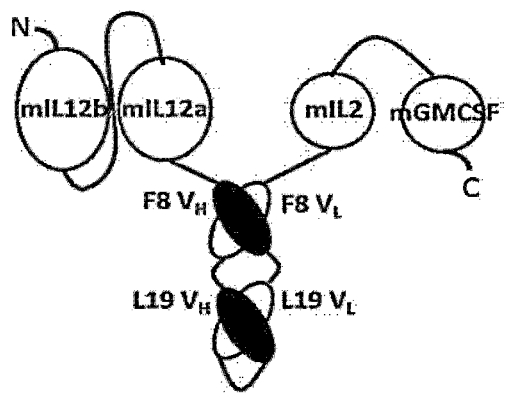
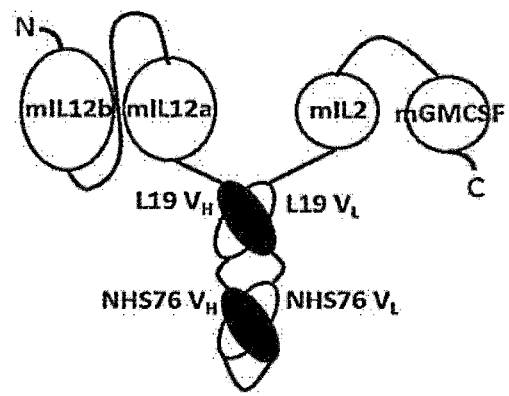
FIG. 9
FIG. 10
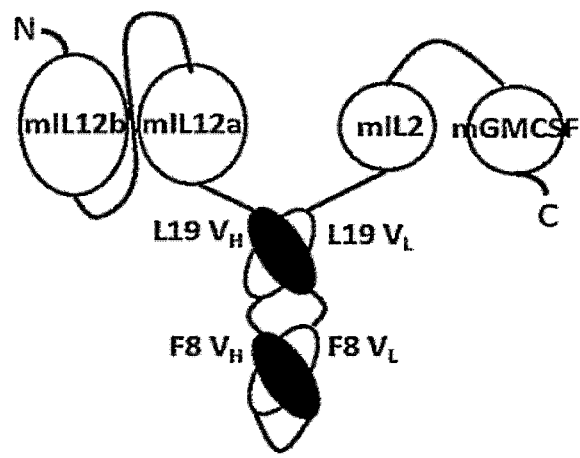
FIG. 11
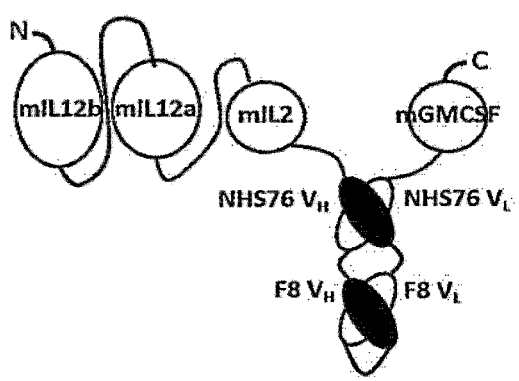
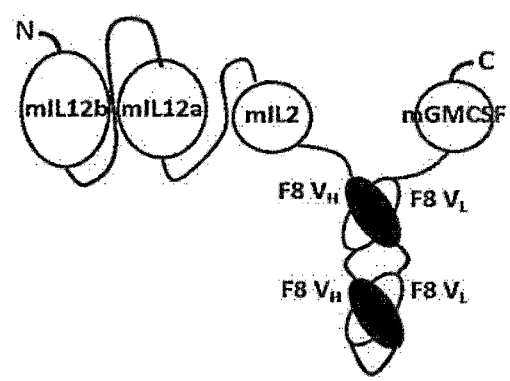
FIG. 12
FIG. 13

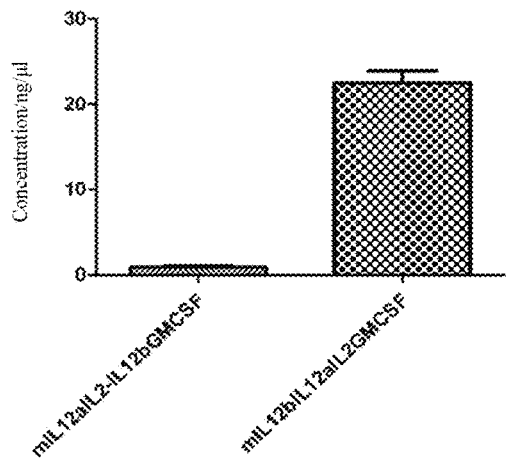
FIG. 36
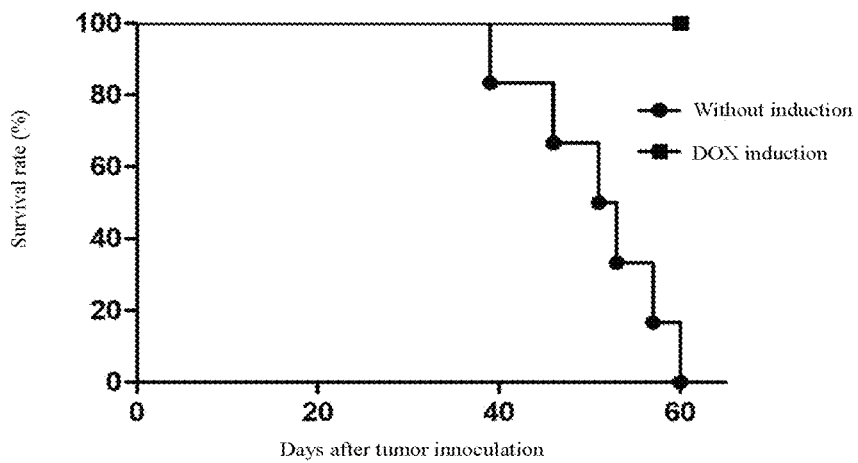
FIG. 37
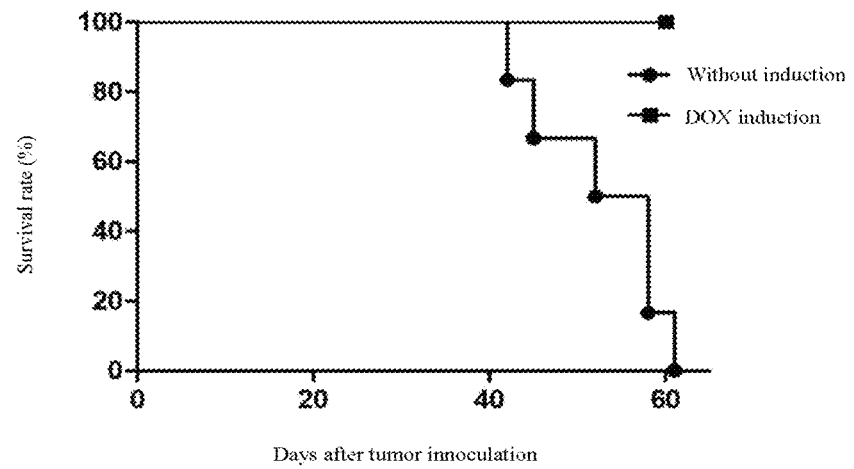

PROTEIN MOLECULE OF INTERLEUKINS 12a AND b COMBINED WITH ADDITIONAL FACTORS

This application is a National Stage Application and claims priority under 35 U.S.C. § 371 to Patent Cooperation Treaty application PCT/CN2020/086751, filed Apr. 24, 2020, which claims the benefit of Chinese application CN2019103483571, filed Apr. 28, 2019. Priority is claimed to these applications and the disclosures of these prior applications are considered part of the disclosure of this application and to the extent allowed the entire contents of the aforementioned applications are incorporated herein by reference.

TECHNICAL FIELD

The present application relates to the field of biological medicine, and in particular, relates to a protein molecule and uses thereof.

BACKGROUND ART

Tumor is a disease that seriously threatens the health of human beings. In recent years, immunotherapy, as a new therapy, has shown great potential in tumor treatment. Cytokine is a very important immune signal in the body, and cytokine fusion protein technology is another popular field for tumor immunotherapy today. This technology is to fuse two or more types of cytokines together by using the genetic engineering technology based on the fact that these cytokines have the same or related functional activities but with different targets respectively. However, the current tumor treatment using the cytokine fusion protein technology is still unsatisfactory, and there is much room for improvement.

SUMMARY OF THE INVENTION

The present application provides a protein molecule, comprising IL12a or a functional fragment thereof, IL12b or a functional fragment thereof, a first factor and a second factor, wherein the first factor and the second factor are each independently selected from the group consisting of: IL2, GMCSF, IL7, IL15, IL21 and FLT3L; and the IL12a or the functional fragment thereof, the IL12b or the functional fragment thereof, the first factor and the second factor are located in the same polypeptide chain.

In some embodiments, the first factor is different from the second factor.

In some embodiments, the first factor and the second factor are selected from the following groups: the first factor is IL2, and the second factor is GMCSF; the first factor is IL7, and the second factor is GMCSF; the first factor is IL15, and the second factor is GMCSF; the first factor is IL21, and the second factor is GMCSF; the first factor is IL2, and the second factor is FLT3L; the first factor is IL7, and the second factor is FLT3L; the first factor is IL15, and the second factor is FLT3L; the first factor is IL21, and the second factor is FLT3L; the first factor is GMCSF, and the second factor is IL2; the first factor is GMCSF, and the second factor is IL7; the first factor is GMCSF, and the second factor is IL15; the first factor is GMCSF, and the second factor is IL21; the first factor is FLT3L, and the second factor is IL2; the first factor is FLT3L, and the second factor is IL7; the first factor is FLT3L, and the second factor is IL15; and the first factor is FLT3L, and the second factor is IL21.

In some embodiments, the IL12a or the functional fragment thereof, the IL12b or the functional fragment thereof, the first factor and/or the second factor are/is derived from mammal.

In some embodiments, the IL12a or the functional fragment thereof, the IL12b or the functional fragment thereof, the first factor and/or the second factor are/is derived from the same species.

In some embodiments, the same species is human.

In some embodiments, the IL12b or the functional fragment thereof is located at an N-terminal of the polypeptide chain.

In some embodiments, the IL12a or the functional fragment thereof is located at a C-terminal of the IL12b or of the functional fragment thereof.

In some embodiments, the C-terminal of the IL12b or of the functional fragment thereof is directly or indirectly linked to an N-terminal of the IL12a or of the functional fragment thereof.

In some embodiments, the first factor is located at a C-terminal of the IL12a or of the functional fragment thereof.

In some embodiments, an N-terminal of the first factor is directly or indirectly linked to the C-terminal of the IL12a or of the functional fragment thereof.

In some embodiments, the protein molecule sequentially comprises the IL12b or the functional fragment thereof, the IL12a or the functional fragment thereof, the first factor and the second factor from the N-terminal to the C-terminal.

In some embodiments, the second factor is located at the C-terminal of the IL12a or of the functional fragment thereof.

In some embodiments, an N-terminal of the second factor is directly or indirectly linked to the C-terminal of the IL12a or of the functional fragment thereof.

In some embodiments, the protein molecule sequentially comprises the IL12b or the functional fragment thereof, the IL12a or the functional fragment thereof, the second factor and the first factor from the N-terminal to the C-terminal.

In some embodiments, the protein molecule comprises any one selected from amino acid sequences as set forth in the group consisting of: SEQ ID NOs: 32-48.

In some embodiments, the protein molecule further comprises a targeting moiety, wherein the targeting moiety, the IL12b or the functional fragment thereof, the IL12a or the functional fragment thereof, the first factor and the second factor are located in the same polypeptide chain.

In some embodiments, the targeting moiety is located at the C-terminal of the IL12a or of the functional fragment thereof.

In some embodiments, an N-terminal of the targeting moiety is directly or indirectly linked to the C-terminal of the IL12a or of the functional fragment thereof.

In some embodiments, the protein molecule sequentially comprises the IL12b or the functional fragment thereof, the IL12a or the functional fragment thereof, the targeting moiety, the first factor and the second factor from the N-terminal to the C-terminal.

In some embodiments, the protein molecule sequentially comprises the IL12b or the functional fragment thereof, the IL12a or the functional fragment thereof, the targeting moiety, the second factor and the first factor from the N-terminal to the C-terminal.

In some embodiments, the targeting moiety is located at the C-terminal of the first factor.

In some embodiments, the N-terminal of the targeting moiety is directly or indirectly linked to the C-terminal of the first factor.

In some embodiments, the protein molecule sequentially comprises the IL12b or the functional fragment thereof, the IL12a or the functional fragment thereof, the second factor, the first factor and the targeting moiety from the N-terminal to the C-terminal.

In some embodiments, the protein molecule sequentially comprises the IL12b or the functional fragment thereof, the IL12a or the functional fragment thereof, the first factor, the targeting moiety and the second factor from the N-terminal to the C-terminal.

In some embodiments, the targeting moiety is located at the C-terminal of the second factor.

In some embodiments, the N-terminal of the targeting moiety is directly or indirectly linked to the C-terminal of the second factor.

In some embodiments, the protein molecule sequentially comprises the IL12b or the functional fragment thereof, the IL12a or the functional fragment thereof, the first factor, the second factor and the targeting moiety from the N-terminal to the C-terminal.

In some embodiments, the protein molecule sequentially comprises the IL12b or the functional fragment thereof, the IL12a or the functional fragment thereof, the second factor, the targeting moiety and the first factor from the N-terminal to the C-terminal.

In some embodiments, the number of the targeting moiety is one or more.

In some embodiments, the one or more targeting moieties are the same.

In some embodiments, the one or more targeting moieties are different.

In some embodiments, the one or more targeting moieties are capable of specifically targeting a tumor-associated antigen.

In some embodiments, the tumor-associated antigen is selected from the group consisting of: an EDB domain of fibronectin, an EDA domain of fibronectin, and/or a necrotic region.

In some embodiments, the one or more targeting moieties comprise an antibody or an antigen-binding fragment thereof.

In some embodiments, the antigen-binding fragment is selected from the group consisting of: Fab, Fab', F(ab')$_2$, F(ab)$_2$, dAb, an isolated complementarity determining region CDR, Fv and scFv.

In some embodiments, the antigen-binding fragment is an scFv.

In some embodiments, the one or more targeting moieties comprise any one selected from amino acid sequences as set forth in the group consisting of: SEQ ID NOs: 1-9.

In some embodiments, the indirect linking is performed via a linker.

In some embodiments, the linker is a peptide linker.

In some embodiments, the linker is linked to the one or more targeting moieties, and the linker comprises a thrombin cleavage site.

In some embodiments, the linker comprises any one selected from amino acid sequences as set forth in the group consisting of: SEQ ID NOs: 114-117.

In some embodiments, the protein molecule comprises any one selected from amino acid sequences as set forth in the group consisting of: SEQ ID NOs: 49-71.

The present application provides a nucleotide molecule encoding the defined protein molecule.

In some embodiments, the nucleotide molecule comprises any one selected from nucleotide sequences as set forth in the group consisting of: SEQ ID NOs: 73-112.

The present application provides a vector comprising the defined nucleotide molecule.

The present application provides a cell expressing the defined protein molecule, or comprising the defined nucleotide molecule, or comprising the defined vector.

The present application provides a method for preparing the defined protein molecule, comprising the following step: culturing the defined cell.

The present application provides a pharmaceutical composition comprising the defined protein molecule.

The present application provides uses of the defined protein molecule and the defined pharmaceutical composition in the preparation of an anti-tumor drug.

In some embodiments, the tumor comprises a solid tumor.

In some embodiments, the tumor comprises melanoma.

The present application provides a method for preventing, alleviating or treating a tumor, comprising administering the heterodimer and/or the pharmaceutical composition to a subject in need thereof.

In some embodiments, the tumor comprises a solid tumor.

In some embodiments, the tumor comprises melanoma.

Those skilled in the art can easily perceive other aspects and advantages of the present application from the detailed description below. The detailed description below only shows and describes exemplary embodiments of the present application. As will be appreciated by those skilled in the art, the content of the present application enables those skilled in the art to make changes to the disclosed specific embodiments without departing from the spirit and scope of the invention involved in the present application. Correspondingly, the accompanying drawings and the descriptions in the specification of the present application are merely for an exemplary rather than restrictive purpose.

BRIEF DESCRIPTION OF THE DRAWINGS

The specific features of the present invention involved in the present application are listed in the appended claims. The characteristics and advantages of the present invention involved in the present application can be better understood by referring to the exemplary embodiments and the accompanying drawings described in detail below. The accompanying drawings are briefly illustrated as follows:

FIGS. 3-20 show the structures of protein molecules according to the present application;

FIG. 36 shows the expression levels of the protein molecule mIL12bIL12aIL2GMCSF and the double-stranded fusion protein mIL12aIL2-IL12bGMCSF;

FIG. 37 shows the effect of a protein molecule mIL12bIL12aIL2GMCSF on the survival rate of mice;

FIG. 38 shows the effect of a protein molecule mIL12bIL12aGMCSFIL2 on the survival rate of mice;

DETAILED DESCRIPTION OF THE PREFERRED EMBODIMENTS

Figure 1:
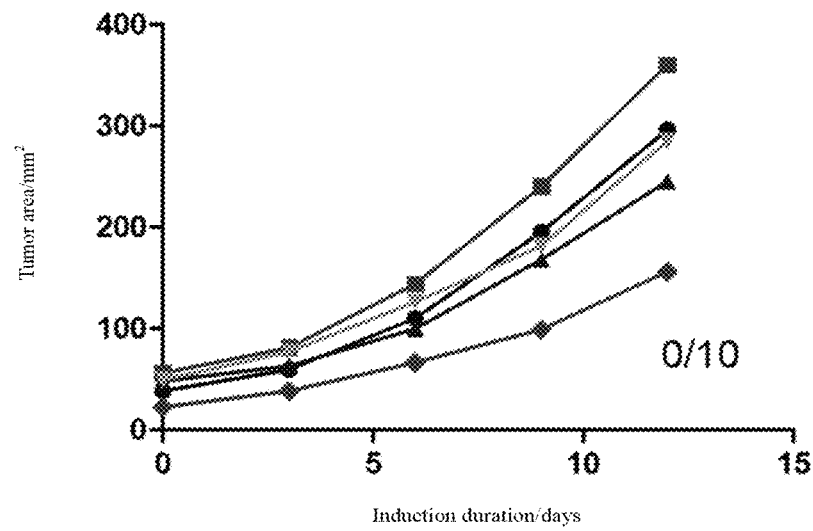
FIG. 1 shows the effect of regulating and expressing GFP on the growth of tumors in mice.

The embodiments of the invention of the present application will be illustrated by specific examples below. Those familiar with this technology can easily understand other advantages and effects of the invention of the present application from the content disclosed in the specification.

In the present application, the term "protein molecule" can be considered as a "cytokine fusion protein", and is generally refers to a fusion protein that can be obtained by fusing two or more cytokines together through the gene recombination technology. The protein molecule not only may have the unique biological activities of the constituent factors thereof or significantly improve some activities, but also may exert combined biological functions that are not achieved by the simple compatibility of single cytokines through the complementary and synergistic effects of biological activities, and may even produce some new structures and biological functions.

In the present application, the term "polypeptide chain" generally refers to a chain structure formed by linking a plurality of amino acids to each other and containing a plurality of peptide bonds. In the present application, the polypeptide may include IL12a or a functional fragment thereof, IL12b or a functional fragment thereof, a first factor and a second factor, wherein the first factor and the second factor are each independently selected from the group consisting of: IL2, GMCSF, IL7, IL15, IL21 and FLT3L. In some cases, the polypeptide chain may also include one or more targeting moieties.

In the present application, the term "targeting moiety" refers to a type of moiety that acts on certain special tissues and cells. For example, the targeting moiety is capable of specifically targeting a tumor-associated antigen. In the present application, the targeting moiety includes an antibody or an antigen-binding fragment thereof.

In the present application, the term "tumor-associated antigen" (TAA) refers to an antigen molecule existing on a tumor cell or a normal cell. The tumor-associated antigen may include: an embryonic protein, a glycoprotein antigen and a squamous cell antigen. The tumor-associated antigen is selected from the group consisting of: an EDB domain of fibronectin, an EDA domain of fibronectin, and a necrotic region.

In the present application, the term "antigen-binding fragment" generally refers to a fragment having an antigen-binding activity. In the present application, the antigen-binding fragment may be selected from the group consisting of: Fab, Fab', F(ab')$_2$, F(ab)$_2$, dAb, an isolated complementarity determining region (CDR), Fv and scFv.

In the present application, the term "antibody" is capable of specifically recognizing and/or neutralizing a polypeptide molecule of a specific antigen. A basic four-chain antibody unit is a heterotetrameric glycoprotein, which may be composed of two identical light chains and two identical heavy chains. In the case of IgG, each light chain may be linked to each heavy chain by a covalent disulfide bond, and two heavy chains may be linked to each other by a disulfide bond. Each heavy chain has a variable domain (VH) at an N-terminal, followed by three (for α and γ types) or four (for μ and ε isotypes) constant domains (CH). In the present application, the terms "IL12a", "IL12b", "IL2", "GMCSF", "IL7", IL15", "IL21", and "FLT3L" may be considered as "cytokines". The "cytokine" generally refers to a class of small molecular proteins synthesized and secreted by stimulating immune cells (such as monocytes, macrophages, T cells, B cells, NK cells, etc.) and certain non-immune cells (such as endothelial cells, epidermal cells, fibroblasts, etc.), showing a broad spectrum of biological activities. The cytokine plays an important role in regulating inter-cellular interaction as well as cell growth and differentiation. In the present application, the cytokine may be one or more selected from the group consisting of: interleukin (IL), an FMS-associated tyrosine kinase 3 ligand (FLT3L) and a colony stimulating factor (CSF). The interleukin generally refers to a cytokine produced by lymphocytes, monocytes or other non-mononuclear cells. In the present application, the interleukin may be one or more selected from the group consisting of: IL12, IL2, IL7, IL15, and IL21. In the present application, the colony stimulating factor generally refers to a cytokine capable of stimulating different hematopoietic stem cells to form cell colonies in a semi-solid medium. In the present application, the colony stimulating factor may be a granulocyte macrophage colony stimulating factor (GMCSF).

In the present application, the term "IL12" generally refers to interleukin-12. IL12 may play an important role in regulating inter-cellular interaction, immune regulation, hematopoiesis, and inflammation. An IL12 molecule is generally a heterodimer typically including two subunits, namely, a p40 subunit (40 kd) and a p35 subunit (35 kd) respectively, which are linked together via a disulfide bond. In the present application, IL12 containing the p35 subunit (35 kd) may be represented as IL12a, and IL12 containing the p40 subunit (40 kd) may be represented as IL12b. For example, in murine-derived IL12 (mIL12), the p35 subunit may include an amino acid sequence as set forth in SEQ ID NO: 16, and the p40 subunit may include an amino acid sequence as set forth in SEQ ID NO: 17. For another example, in human-derived IL12 (hIL12), the p35 subunit may include an amino acid sequence as set forth in SEQ ID NO: 18, and the p40 subunit may include an amino acid sequence as set forth in SEQ ID NO: 19.

In the present application, the term "IL2" generally refers to interleukin-2. IL2 plays an important role in regulating inter-celluar interaction, immune regulation, hematopoiesis, and inflammation. For example, murine-derived IL2 (mIL2) may include an amino acid sequence as set forth in SEQ ID NO:20. For another example, human-derived IL2 (hIL2) may include an amino acid sequence as set forth in SEQ ID NO:21.

In the present application, the term "IL15" generally refers to interleukin-15. IL15 plays an important role in regulating inter-celluar interaction, immune regulation, hematopoiesis, and inflammation. For example, murine-derived IL15 (mIL15) may include an amino acid sequence as set forth in SEQ ID NO:22. For another example, human-derived IL15 (hIL15) may include an amino acid sequence as set forth in SEQ ID NO:23.

In the present application, the term "IL7" generally refers to interleukin-7. IL7 plays an important role in regulating inter-cellular interaction, immune regulation, hematopoiesis, and inflammation. For example, murine-derived IL7 (mIL7) may include an amino acid sequence as set forth in SEQ ID NO:24. For another example, human-derived IL7 (hIL7) may include an amino acid sequence as set forth in SEQ ID NO:25.

In the present application, the term "IL21" generally refers to interleukin-21. IL21 plays an important role in regulating inter-cellular interaction, immune regulation, hematopoiesis, and inflammation. For example, murine-derived IL21 (mIL21) may include an amino acid sequence as set forth in SEQ ID NO:26. For another example, human-derived IL21 (hIL21) may include an amino acid sequence as set forth in SEQ ID NO:27.

In the present application, the term "FLT3L" generally refers to an FMS-associated tyrosine kinase 3 ligand, which is capable of regulating the proliferation and differentiation of non-erythroid hematopoietic stem cells, and promoting the proliferation, differentiation and maturation of B pro-lymphocytes, dendritic cells, NK cells, and T toxic T lymphocytes, showing important anti-tumor effects. For example, murine-derived FLT3L (mFLT3L) may include an amino acid sequence as set forth in SEQ ID NO:28. For another example, human-derived FLT3L (hFLT3L) may include an amino acid sequence as set forth in SEQ ID NO:29.

In the present application, the term "GMCSF" generally refers to a granulocyte macrophage colony stimulating factor. The GMCSF may have 4 α-helix bundle structures. For example, murine-derived GMCSF (mGMCSF) may include an amino acid sequence as set forth in SEQ ID NO:30. For another example, human-derived GMCSF (hGMCSF) may include an amino acid sequence as set forth in SEQ ID NO:31.

In the present application, the term "functional fragment" generally refers to a fragment that retains a certain specific function. For example, a functional fragment of IL12a refers to a fragment that retains the function of IL12a. For example, the functional fragment of IL12a may be an IL12a fragment (GenBank: AIC49052.1). For example, the functional fragment of IL12b may be an IL12b fragment (GenBank: AIC54621.1).

In the present application, the term "directly linked" is opposite to the term "indirectly linked", and the term "directly linked" generally refers to a direct linkage. For example, the direct linkage may be a situation where substances (for example, the same or different cytokines and/or targeting moieties) are directly linked without a spacer. The spacer may be a linker. For example, the linker may be a peptide linker. The term "indirectly linked" generally refers to a situation where substances (for example, the same or different cytokines and/or targeting moieties) are not directly linked. For example, the indirect linkage may be a situation where a linkage is performed via a spacer. For example, the N-terminal of the IL2 is directly linked to or indirectly linked via a linker to the C-terminal of the IL12b or of the functional fragment thereof. For another example, the N-terminal of the GMCSF is directly linked to or indirectly linked via a linker to the C-terminal of the IL12b or of the functional fragment thereof.

In the present application, the term "nucleotide molecule" generally refers to a biological macromolecular compound polymerized from many nucleotides. In terms of different chemical compositions, the nucleic acid molecules may be classified into ribonucleic acids (RNAs for short) and deoxyribonucleic acids (DNAs for short). In the present application, the nucleotide molecule encodes the defined protein molecule, and may include a nucleotide sequence as set forth in any one of SEQ ID NOs. 73-112.

In the present application, the term "vector" generally refers to a nucleic acid molecule capable of self-replication in a suitable host cell. It transfers an inserted nucleic acid molecule into and/or between host cells. The vector may include a vector mainly for inserting DNA or RNA into cells, a vector mainly for replicating DNA or RNA, and a vector mainly for expressing DNA or RNA transcription and/or translation. The vector may also include a carrier having a variety of the functions defined above. The vector may be a polynucleotide that may be transcribed and translated into a polypeptide when introduced into a suitable host cell. Generally, the vector may produce a desired expression product by culturing a suitable host cell containing the vector.

In the present application, the term "cell" generally refers to an individual cell, a cell line or a cell culture, which may contain or already contains the nucleotide molecule described in the present application or the vector described in the present application, or is capable of expressing the protein molecule described in the present application. The cell may include a progeny of a single host cell. Due to natural, accidental or deliberate mutations, progeny cells and original parent cells may not necessarily be identical in terms of morphology or genome as long as they are capable of expressing the protein molecule described in the present application or containing the nucleotide molecule or vector described in the present application. In the present application, a cell capable of expressing the protein molecule described in the present application may be obtained by transfecting a B16 (rtTA) tumor cell or a 293A cell with a virus of the expression vector.

In the present application, the term "tumor" generally refers to or describes a physiological condition of mammals, with the typical feature consisting in the disorder of cell proliferation or survival. For example, the tumor may include a solid tumor. For another example, the tumor may be melanoma.

In the present application, the term "solid tumor" generally refers to a tangible mass that may be diagnosed by clinical examination (such as X-ray photography, CT scanning, B-scan ultrasonography or palpation, etc.). In the present application, the solid tumor may be melanoma.

In the present application, the term "melanoma" generally refers to a pigmented nevus with malignant transformation. The melanoma may develop from a nevus with the properties of a junctional nevus or a compound nevus, with the manifestation of symptoms such as sudden incidence or rapid growth and continuously deepened color of a pigmented nevus.

Protein Molecule

In one aspect, the present application provides a protein molecule, comprising IL12a or a functional fragment thereof, IL12b or a functional fragment thereof, a first factor and a second factor, wherein the first factor and the second factor are each independently selected from the group consisting of: IL2, GMCSF, IL7, IL15, IL21 and FLT3L; and the IL12a or the functional fragment thereof, the IL12b or the functional fragment thereof, the first factor and the second factor are located in the same polypeptide chain.

In the present application, the protein molecule may be a cytokine fusion protein, where the cytokines, i.e., two or more of IL12, IL2ˋ IL7, IL15, IL21, FLT3L and GMCSF, are fused together through the gene recombination technology. The protein molecule not only may have the unique biological activities of the constituent factors thereof, but also may exert biological functions that are not possessed by a single cytokine through the complementary and synergistic effects of biological activities, and may even produce some new structures and biological functions.

In the present application, the cytokine may be selected from the group consisting of: IL12, IL2ˋ IL7, IL15, IL21, FLT3L and GMCSF.

In the present application, the first factor is different from the second factor.

In the present application, the first factor and the second factor may be selected from the following groups: the first factor is IL2, and the second factor is GMCSF; the first factor is IL7, and the second factor is GMCSF; the first factor is IL15, and the second factor is GMCSF; the first factor is IL21, and the second factor is GMCSF; the first factor is IL2, and the second factor is FLT3L; the first factor is IL7, and the second factor is FLT3L; the first factor is IL15, and the second factor is FLT3L; the first factor is IL21, and the second factor is FLT3L; the first factor is GMCSF, and the second factor is IL2; the first factor is GMCSF, and the second factor is IL7; the first factor is GMCSF, and the second factor is IL15; the first factor is GMCSF, and the second factor is IL21; the first factor is FLT3L, and the second factor is IL2; the first factor is FLT3L, and the second factor is IL7; the first factor is FLT3L, and the second factor is IL15; and the first factor is FLT3L, and the second factor is IL21.

In the present application, the IL12a or the functional fragment thereof, the IL12b or the functional fragment thereof, the first factor and/or the second factor may be derived from mammal.

In the present application, the IL12a or the functional fragment thereof, the IL12b or the functional fragment thereof, the first factor and/or the second factor may be derived from the same species, which may be human.

In the present application, the IL12a or the functional fragment thereof, the IL12b or the functional fragment thereof, the first factor and the second factor may be derived from human, and the human-derived IL12a, IL12b, IL2, IL7, IL15, IL21, FLT3L and GMSCF may be written as hIL12a, hIL2, hIL7, hIL15, hIL21, hFLT3L and hGMSCF.

In the present application, the IL12a or the functional fragment thereof, the IL12b or the functional fragment thereof, the first factor and the second factor may be derived from mouse, and the murine-derived IL12a, IL12b, IL2, IL7, IL15, IL21, FLT3L and GMSCF can be written as mIL12a, mIL12b, mIL2, mIL7, mIL15, mIL21, mFLT3L and mGMSCF.

In the present application, the IL12b or the functional fragment thereof may be located at an N-terminal of the polypeptide chain.

In the present application, the IL12a or the functional fragment thereof may be located at the C-terminal of the IL12b or of the functional fragment thereof.

In the present application, the C-terminal of the IL12b or of the functional fragment thereof may be directly or indirectly linked to the N-terminal of the IL12a or of the functional fragment thereof.

In the present application, the first factor may be located at the C-terminal of the IL12a or of the functional fragment thereof.

In the present application, an N-terminal of the first factor may be directly or indirectly linked to the C-terminal of the IL12a or of the functional fragment thereof.

In the present application, the protein molecule may sequentially comprise the IL12b or the functional fragment thereof, the IL12a or the functional fragment thereof, the first factor and the second factor from the N-terminal to the C-terminal.

In the present application, the second factor may be located at the C-terminal of the IL12a or of the functional fragment thereof.

In the present application, an N-terminal of the second factor may be directly or indirectly linked to the C-terminal of the IL12a or of the functional fragment thereof.

In the present application, the protein molecule may sequentially comprise the IL12b or the functional fragment thereof, the IL12a or the functional fragment thereof, the second factor and the first factor from the N-terminal to the C-terminal.

For example, the structure of the protein molecule may be as follows: the C-terminal of the IL12b is fused to the N-terminal of the IL12a; the C-terminal of the IL12a is fused to the N-terminal of the IL2; and the C-terminal of the IL2 is fused to the N-terminal of the GMCSF, thereby forming a protein molecule IL12b-IL12a-IL2-GMCSF.

For example, the structure of the protein molecule may be as follows: the C-terminal of the IL12b is fused to the N-terminal of the IL12a; the C-terminal of the IL12a is fused to the N-terminal of the IL7; and the C-terminal of the IL7 is fused to the N-terminal of the GMCSF, thereby forming a protein molecule IL12b-IL12a-IL7-GMCSF.

For example, the structure of the protein molecule may be as follows: the C-terminal of the IL12b is fused to the N-terminal of the IL12a; the C-terminal of the IL12a is fused to the N-terminal of the IL15; and the C-terminal of the IL15 is fused to the N-terminal of the GMCSF, thereby forming a protein molecule IL12b-IL12a-IL15-GMCSF.

For example, the structure of the protein molecule may be as follows: the C-terminal of the IL12b is fused to the N-terminal of the IL12a; the C-terminal of the IL12a is fused to the N-terminal of the IL21; and the C-terminal of the IL21 is fused to the N-terminal of the GMCSF, thereby forming a protein molecule IL12b-IL12a-IL21-GMCSF.

For example, the structure of the protein molecule may be as follows: the C-terminal of the IL12b is fused to the N-terminal of the IL12a; the C-terminal of the IL12a is fused to the N-terminal of the IL2; and the C-terminal of the IL2 is fused to the N-terminal of the FLT3L, thereby forming a protein molecule IL12b-IL12a-IL2-FLT3L.

For example, the structure of the protein molecule may be as follows: the C-terminal of the IL12b is fused to the N-terminal of the IL12a; the C-terminal of the IL12a is fused to the N-terminal of the IL7; and the C-terminal of the IL7 is fused to the N-terminal of the FLT3L, thereby forming a protein molecule IL12b-IL12a-IL7-FLT3L.

For example, the structure of the protein molecule may be as follows: the C-terminal of the IL12b is fused to the N-terminal of the IL12a; the C-terminal of the IL12a is fused to the N-terminal of the IL15; and the C-terminal of the IL15 is fused to the N-terminal of the FLT3L, thereby forming a protein molecule IL12b-IL12a-IL15-FLT3L.

For example, the structure of the protein molecule may be as follows: the C-terminal of the IL12b is fused to the N-terminal of the IL12a; the C-terminal of the IL12a is fused to the N-terminal of the IL21; and the C-terminal of the IL21 is fused to the N-terminal of the FLT3L, thereby forming a protein molecule IL12b-IL12a-IL21-FLT3L.

For example, the structure of the protein molecule may be as follows: the C-terminal of the IL12b is fused to the N-terminal of the IL12a; the C-terminal of the IL12a is fused to the N-terminal of the GMCSF; and the C-terminal of the GMCSF is fused to the N-terminal of the IL2, thereby forming a protein molecule IL12b-IL12a-GMCSF-IL2.

For example, the structure of the protein molecule may be as follows: the C-terminal of the IL12b is fused to the N-terminal of the IL12a; the C-terminal of the IL12a is fused to the N-terminal of the GMCSF; and the C-terminal of the GMCSF is fused to the N-terminal of the IL7, thereby forming a protein molecule IL12b-IL12a-GMCSF-IL7.

For example, the structure of the protein molecule may be as follows: the C-terminal of the IL12b is fused to the N-terminal of the IL12a; the C-terminal of the IL12a is fused to the N-terminal of the GMCSF; and the C-terminal of the GMCSF is fused to the N-terminal of the IL15, thereby forming a protein molecule IL12b-IL12a-GMCSF-IL15.

For example, the structure of the protein molecule may be as follows: the C-terminal of the IL12b is fused to the N-terminal of the IL12a; the C-terminal of the IL12a is fused to the N-terminal of the GMCSF; and the C-terminal of the GMCSF is fused to the N-terminal of the IL21, thereby forming a protein molecule IL12b-IL12a-GMCSF-IL21.

For example, the structure of the protein molecule may be as follows: the C-terminal of the IL12b is fused to the N-terminal of the IL12a; the C-terminal of the IL12a is fused to the N-terminal of the FLT3L; and the C-terminal of the FLT3L is fused to the N-terminal of the IL2, thereby forming a protein molecule IL12b-IL12a-FLT3L-IL2.

For example, the structure of the protein molecule may be as follows: the C-terminal of the IL12b is fused to the N-terminal of the IL12a; the C-terminal of the IL12a is fused to the N-terminal of the FLT3L; and the C-terminal of the FLT3L is fused to the N-terminal of the IL7, thereby forming a protein molecule IL12b-IL12a-FLT3L-IL7.

For example, the structure of the protein molecule may be as follows: the C-terminal of the IL12b is fused to the N-terminal of the IL12a; the C-terminal of the IL12a is fused to the N-terminal of the FLT3L; and the C-terminal of the FLT3L is fused to the N-terminal of the IL15, thereby forming a protein molecule IL12b-IL12a-FLT3L-IL15.

For example, the structure of the protein molecule may be as follows: the C-terminal of the IL12b is fused to the N-terminal of the IL12a; the C-terminal of the IL12a is fused to the N-terminal of the FLT3L; and the C-terminal of the FLT3L is fused to the N-terminal of the IL21, thereby forming a protein molecule IL12b-IL12a-FLT3L-IL21.

In the present application, the protein molecule may include any one selected from amino acid sequences as set forth in the group consisting of: SEQ ID NOs: 32-48.

For example, the structure of the protein molecule may be as follows: the C-terminal of the mIL12b is fused to the N-terminal of the mIL12a, the C-terminal of the mIL12a is fused to the N-terminal of the mIL2, and the C-terminal of the mIL2 is fused to the N-terminal of the mGMCSF, thereby forming a protein molecule mIL12b-mIL12a-mIL2-mGMCSF (with an amino acid sequence that may be as set forth in SEQ ID NO. 32).

For example, the structure of the protein molecule may be as follows: the C-terminal of the mIL12b is fused to the N-terminal of the mIL12a, the C-terminal of the mIL12a is fused to the N-terminal of the mIL7, and the C-terminal of the mIL7 is fused to the N-terminal of the mGMCSF, thereby forming a protein molecule mIL12b-mIL12a-mIL7-mGMCSF (with an amino acid sequence that may be as set forth in SEQ ID NO. 33).

For example, the structure of the protein molecule may be as follows: the C-terminal of the mIL12b is fused to the N-terminal of the mIL12a, the C-terminal of the mIL12a is fused to the N-terminal of the mIL15, and the C-terminal of the mIL15 is fused to the N-terminal of the mGMCSF, thereby forming a protein molecule mIL12b-mIL12a-mIL15-mGMCSF (with an amino acid sequence that may be as set forth in SEQ ID NO. 34).

For example, the structure of the protein molecule may be as follows: the C-terminal of the mIL12b is fused to the N-terminal of the mIL12a, the C-terminal of the mIL12a is fused to the N-terminal of the mIL21, and the C-terminal of the mIL21 is fused to the N-terminal of the mGMCSF, thereby forming a protein molecule mIL12b-mIL12a-mIL21-mGMCSF (with an amino acid sequence that may be as set forth in SEQ ID NO. 35).

For example, the structure of the protein molecule may be as follows: the C-terminal of the mIL12b is fused to the N-terminal of the mIL12a, the C-terminal of the mIL12a is fused to the N-terminal of the mIL2, and the C-terminal of the mIL2 is fused to the N-terminal of the mFLT3L, thereby forming a protein molecule mIL12b-mIL12a-mIL2-mFLT3L (with an amino acid sequence that may be as set forth in SEQ ID NO. 36).

For example, the structure of the protein molecule may be as follows: the C-terminal of the mIL12b is fused to the N-terminal of the mIL12a, the C-terminal of the mIL12a is fused to the N-terminal of the mIL7, and the C-terminal of the mIL7 is fused to the N-terminal of the mFLT3L, thereby forming a protein molecule mIL12b-mIL12a-mIL7-mFLT3L (with an amino acid sequence that may be as set forth in SEQ ID NO. 37).

For example, the structure of the protein molecule may be as follows: the C-terminal of the mIL12b is fused to the N-terminal of the mIL12a, the C-terminal of the mIL12a is fused to the N-terminal of the mIL15, and the C-terminal of the mIL15 is fused to the N-terminal of the mFLT3L, thereby forming a protein molecule mIL12b-mIL12a-mIL15-mFLT3L (with an amino acid sequence that may be as set forth in SEQ ID NO. 38).

For example, the structure of the protein molecule may be as follows: the C-terminal of the mIL12b is fused to the N-terminal of the mIL12a, the C-terminal of the mIL12a is fused to the N-terminal of the mIL21, and the C-terminal of the mIL21 is fused to the N-terminal of the mFLT3L, thereby forming a protein molecule mIL12b-mIL12a-mIL21-mFLT3L (with an amino acid sequence that may be as set forth in SEQ ID NO. 39).

For example, the structure of the protein molecule may be as follows: the C-terminal of the mIL12b is fused to the N-terminal of the mIL12a, the C-terminal of the mIL12a is fused to the N-terminal of the mGMCSF, and the C-terminal of the mGMCSF is fused to the N-terminal of the mIL2, thereby forming a protein molecule mIL12b-mIL12a-mGMCSF-mIL2 (with an amino acid sequence that may be as set forth in SEQ ID NO. 40).

For example, the structure of the protein molecule may be as follows: the C-terminal of the hIL12b is fused to the N-terminal of the hIL12a, the C-terminal of the hIL12a is fused to the N-terminal of the hIL2, and the C-terminal of the hIL2 is fused to the N-terminal of the hGMCSF, thereby forming a protein molecule hIL12b-hIL12a-hIL2-hGMCSF (with an amino acid sequence that may be as set forth in SEQ ID NO. 41).

For example, the structure of the protein molecule may be as follows: the C-terminal of the hIL12b is fused to the N-terminal of the hIL12a, the C-terminal of the hIL12a is fused to the N-terminal of the hIL7, and the C-terminal of the hIL7 is fused to the N-terminal of the hGMCSF, thereby forming a protein molecule hIL12b-hIL12a-hIL7-hGMCSF (with an amino acid sequence that may be as set forth in SEQ ID NO. 42).

For example, the structure of the protein molecule may be as follows: the C-terminal of the hIL12b is fused to the N-terminal of the hIL12a, the C-terminal of the hIL12a is fused to the N-terminal of the hIL15, and the C-terminal of the hIL15 is fused to the N-terminal of the hGMCSF, thereby forming a protein molecule hIL12b-hIL12a-hIL15-hGMCSF (with an amino acid sequence that may be as set forth in SEQ ID NO. 43).

For example, the structure of the protein molecule may be as follows: the C-terminal of the hIL12b is fused to the N-terminal of the hIL12a, the C-terminal of the hIL12a is fused to the N-terminal of the hIL21, and the C-terminal of the hIL21 is fused to the N-terminal of the hGMCSF, thereby forming a protein molecule hIL12b-hIL12a-hIL21-hGMCSF (with an amino acid sequence that may be as set forth in SEQ ID NO. 44).

For example, the structure of the protein molecule may be as follows: the C-terminal of the hIL12b is fused to the N-terminal of the hIL12a, the C-terminal of the hIL12a is fused to the N-terminal of the hIL2, and the C-terminal of the hIL2 is fused to the N-terminal of the hFLT3L, thereby forming a protein molecule hIL12b-hIL12a-hIL2-hFLT3L (with an amino acid sequence that may be as set forth in SEQ ID NO. 45).

For example, the structure of the protein molecule may be as follows: the C-terminal of the hIL12b is fused to the N-terminal of the hIL12a, the C-terminal of the hIL12a is fused to the N-terminal of the hIL7, and the C-terminal of the hIL7 is fused to the N-terminal of the hFLT3L, thereby forming a protein molecule hIL12b-hIL12a-hIL7-hFLT3L (with an amino acid sequence that may be as set forth in SEQ ID NO. 46).

For example, the structure of the protein molecule may be as follows: the C-terminal of the hIL12b is fused to the N-terminal of the hIL12a, the C-terminal of the hIL12a is fused to the N-terminal of the hIL15, and the C-terminal of the hIL15 is fused to the N-terminal of the hFLT3L, thereby forming a protein molecule hIL12b-hIL12a-hIL15-hFLT3L (with an amino acid sequence that may be as set forth in SEQ ID NO. 47).

For example, the structure of the protein molecule may be as follows: the C-terminal of the hIL12b is fused to the N-terminal of the hIL12a, the C-terminal of the hIL12a is fused to the N-terminal of the hIL21, and the C-terminal of the hIL21 is fused to the N-terminal of the hFLT3L, thereby forming a protein molecule hIL12b-hIL12a-hIL21-hFLT3L (with an amino acid sequence that may be as set forth in SEQ ID NO. 48).

In the present application, said mIL12b-mIL12a-mIL2-mGMCSF, mIL12b-mIL12a-mIL7-mGMCSF, mIL12b-mIL12a-mIL15-mGMCSF, mIL12b-mIL12a-mIL21-mGMCSF, mIL12b-mIL12a-mIL2-mFLT3L, mIL12b-mIL12a-mIL7-mFLT3L, mIL12b-mIL12a-mIL15-mFLT3L, mIL12b-mIL12a-mIL21-mFLT3L, mIL12b-mIL12a-mGMCSF-mIL2, hIL12b-hIL12a-hIL2-hGMCSF, hIL12b-hIL12a-hIL7-hGMCSF, hIL12b-hIL12a-hIL15-hGMCSF, hIL12b-hIL12a-hIL21-hGMCSF, hIL12b-hIL12a-hIL2-hFLT3L, hIL12b-hIL12a-hIL7-hFLT3L, hIL12b-hIL12a-hIL15-hFLT3L and hIL12b-hIL12a-hIL21-hFLT3L may be sequentially referred to as mIL12bIL12aIL2GMCSF, mIL12bIL12aIL7GMCSF, mIL12bIL12aIL15 GMCSF, mIL12bIL12aIL21GMCSF, mIL12bIL12aIL2FLT3L, mIL12bIL12aIL7FLT3L, mIL12bIL12aIL15FLT3L, mIL12bIL12aIL21FLT3L, mIL12bIL12aGMCSFIL2, hIL12bIL12aIL2GMCSF, hIL12bIL12aIL7GMCSF, hIL12bIL12aIL15GMCSF, hIL12bIL12aIL21GMCSF, hIL12bIL12aIL2FLT3L, hIL12bIL12aIL7FLT3L, hIL12bIL12aIL15FLT3L and hIL12bIL12aIL21FLT3L for short, respectively.

In the present application, the protein molecule further includes a targeting moiety. The targeting moiety, the IL12b or the functional fragment thereof, the IL12a or the functional fragment thereof, the first factor and the second factor are located in the same polypeptide chain.

In the present application, the number of the targeting moiety may be one or more. The one or more targeting moieties may be the same or different, and may specifically target a tumor-associated antigen.

In the present application, the tumor-associated antigen may be selected from the group consisting of: an EDB domain of fibronectin, an EDA domain of fibronectin, and/or a necrotic region.

In the present application, the targeting moiety may include an antibody or an antigen-binding fragment thereof.

In the present application, the antigen-binding fragment may be selected from the group consisting of: Fab, Fab', F(ab')$_2$, F(ab)$_2$, dAb, an isolated complementarity determining region (CDR), Fv and scFv.

In the present application, the antigen-binding fragment may be a scFv.

In the present application, the targeting moiety of the protein molecule may be selected from: L19V$_L$ (with an amino acid sequence that may be as set forth in SEQ ID NO. 10), L19V$_H$ (with an amino acid sequence that may be as set forth in SEQ ID NO. 11), F8V$_L$ (with an amino acid sequence that may be as set forth in SEQ ID NO. 12), F8V$_H$ (with an amino acid sequence that may be as set forth in SEQ ID NO. 13), NHS76$V_L$ (with an amino acid sequence that may be as set forth in SEQ ID NO. 14), and NHS76$V_H$ (with an amino acid sequence that may be as set forth in SEQ ID NO. 15).

In the present application, the targeting moiety may be located at the C-terminal of the IL12a or of the functional fragment thereof.

In the present application, the N-terminal of the targeting moiety may be directly or indirectly linked to the C-terminal of the IL12a or of the functional fragment thereof.

In the present application, the protein molecule may sequentially include the IL12b or the functional fragment thereof, the IL12a or the functional fragment thereof, the targeting moiety, the first factor and the second factor from the N-terminal to the C-terminal.

In the present application, the protein molecule may sequentially include the IL12b or the functional fragment thereof, the IL12a or the functional fragment thereof, the targeting moiety, the second factor and the first factor from the N-terminal to the C-terminal.

In the present application, the targeting moiety may be located at the C-terminal of the first factor.

In the present application, the N-terminal of the targeting moiety may be directly or indirectly linked to the C-terminal of the first factor.

In the present application, the protein molecule may sequentially include the IL12b or the functional fragment thereof, the IL12a or the functional fragment thereof, the second factor, the first factor and the targeting moiety from the N-terminal to the C-terminal.

In the present application, the protein molecule may sequentially include the IL12b or the functional fragment thereof, the IL12a or the functional fragment thereof, the first factor, the targeting moiety and the second factor from the N-terminal to the C-terminal.

In the present application, the targeting moiety may be located at the C-terminal of the second factor.

In the present application, the N-terminal of the targeting moiety may be directly or indirectly linked to the C-terminal of the second factor.

In the present application, the protein molecule may sequentially include the IL12b or the functional fragment thereof, the IL12a or the functional fragment thereof, the first factor, the second factor and the targeting moiety from the N-terminal to the C-terminal.

In the present application, the protein molecule may sequentially include the IL12b or the functional fragment thereof, the IL12a or the functional fragment thereof, the second factor, the targeting moiety and the first factor from the N-terminal to the C-terminal.

In the present application, the targeting moiety may include any one selected from amino acid sequences as set forth in the group consisting of: SEQ ID NOs: 1-9.

In the present application, the indirect linking may be performed via a linker.

In the present application, the linker may be a peptide linker.

In the present application, the linker may be linked to the targeting moiety, and the linker may include a thrombin cleavage site.

In the present application, the linker may include any one selected from amino acid sequences as set forth in the group consisting of: SEQ ID NOs: 114-117.

For example, the cytokines may be linked to each other via the linker. In the present application, the IL12a, IL12b, IL2, IL7, IL15, IL21, FLT3L and GMSCF may be linked to one another via the linker peptide. For example, the linker may include an amino acid sequence as set forth in any one of SEQ ID NO. 114 and SEQ ID NO. 116.

For example, the cytokine and the targeting moiety may be linked to each other via the linker. In the present application, the targeting moiety of the protein molecule may be linked to the IL12a, IL12b, IL2, IL7, IL15, IL21, FLT3L and GMSCF via the linker peptides. For example, the linker may include an amino acid sequence as set forth in any one of SEQ ID NOs: 114-117.

For example, the structure of the protein molecule may be as follows: the C-terminal of the IL12b is fused to the N-terminal of the IL12a, the C-terminal of the IL12a is fused to the N-terminal of the L19$V_H$, the C-terminal of the L19$V_H$ is fused to the N-terminal of the L19$V_L$, the C-terminal of the L19$V_L$ is fused to the N-terminal of the L19$V_H$, the C-terminal of the L19$V_H$ is fused to the N-terminal of the L19$V_L$, the C-terminal of the L19$V_L$ is fused to the N-terminal of the IL2, the C-terminal of the IL2 is fused to the N-terminal of the GMCSF, thereby forming a protein molecule IL12b-IL12a-L19$V_H$-L19$V_L$-L19$V_H$-L19$V_L$-IL2-GMCSF.

For example, the structure of the protein molecule may be as follows: the C-terminal of the IL12b is fused to the N-terminal of the IL12a, the C-terminal of the IL12a is fused to the N-terminal of the F8$V_H$, the C-terminal of the F8$V_H$ is fused to the N-terminal of the F8$V_L$, the C-terminal of the F8$V_L$ is fused to the N-terminal of the F8$V_H$, the C-terminal of the F8$V_H$ is fused to the N-terminal of the F8$V_L$, the C-terminal of the F8$V_L$ is fused to the N-terminal of the IL2, the C-terminal of the IL2 is fused to the N-terminal of the GMCSF, thereby forming a protein molecule IL12b-IL12a-F8$V_H$-F8$V_L$-F8$V_H$-F8$V_L$-IL2-GMCSF.

For example, the structure of the protein molecule may be as follows: the C-terminal of the IL12b is fused to the N-terminal of the IL12a, the C-terminal of the IL12a is fused to the N-terminal of the NHS76$V_H$, the C-terminal of the NHS76$V_H$ is fused to the N-terminal of the NHS76$V_L$, the C-terminal of the NHS76$V_L$ is fused to the N-terminal of the NHS76$V_H$, the C-terminal of the NHS76$V_H$ is fused to the N-terminal of the NHS76$V_L$, the C-terminal of the NHS76$V_L$ is fused to the N-terminal of the IL2, the C-terminal of the IL2 is fused to the N-terminal of the GMCSF, thereby forming a protein molecule IL12b-IL12a-NHS76$V_H$-NHS76$V_L$-NHS76$V_H$-NHS76$V_L$-IL2-GMCSF.

For example, the structure of the protein molecule may be as follows: the C-terminal of the IL12b is fused to the N-terminal of the IL12a, the C-terminal of the IL12a is fused to the N-terminal of the NHS76$V_H$, the C-terminal of the NHS76$V_H$ is fused to the N-terminal of the F8$V_L$, the C-terminal of the F8$V_L$ is fused to the N-terminal of the F8$V_H$, the C-terminal of the F8$V_H$ is fused to the N-terminal of the NHS76$V_L$, the C-terminal of the NHS76$V_L$ is fused to the N-terminal of the IL2, the C-terminal of the IL2 is fused to the N-terminal of the GMCSF, thereby forming a protein molecule IL12b-IL12a-NHS76$V_H$-F8$V_L$-F8$V_H$-NHS76$V_L$-IL2-GMCSF.

For example, the structure of the protein molecule may be as follows: the C-terminal of the IL12b is fused to the N-terminal of the IL12a, the C-terminal of the IL12a is fused to the N-terminal of the NHS76$V_H$, the C-terminal of the NHS76$V_H$ is fused to the N-terminal of the L19$V_L$, the C-terminal of the L19$V_L$ is fused to the N-terminal of the L19$V_H$, the C-terminal of the L19$V_H$ is fused to the N-terminal of the NHS76$V_L$, the C-terminal of the NHS76$V_L$ is fused to the N-terminal of the IL2, the C-terminal of the IL2 is fused to the N-terminal of the GMCSF, thereby forming a protein molecule IL12b-IL12a-NHS76V$_H$-L19V$_L$-L19V$_H$-NHS76V$_L$-IL2-GMCSF.

For example, the structure of the protein molecule may be as follows: the C-terminal of the IL12b is fused to the N-terminal of the IL12a, the C-terminal of the IL12a is fused to the N-terminal of the F8V$_H$, the C-terminal of the F8V$_H$ is fused to the N-terminal of the NHS76V$_L$, the C-terminal of the NHS76V$_L$ is fused to the N-terminal of the NHS76V$_H$, the C-terminal of the NHS76V$_H$ is fused to the N-terminal of the F8V$_L$, the C-terminal of the F8V$_L$ is fused to the N-terminal of the IL2, the C-terminal of the IL2 is fused to the N-terminal of the GMCSF, thereby forming a protein molecule IL12b-IL12a-F8V$_H$-NHS76V$_L$-NHS76V$_H$-F8V$_L$-IL2-GMCSF.

For example, the structure of the protein molecule may be as follows: the C-terminal of the IL12b is fused to the N-terminal of the IL12a, the C-terminal of the IL12a is fused to the N-terminal of the F8V$_H$, the C-terminal of the F8V$_H$ is fused to the N-terminal of the L19V$_L$, the C-terminal of the L19V$_L$ is fused to the N-terminal of the L19V$_H$, the C-terminal of the L19V$_H$ is fused to the N-terminal of the F8V$_L$, the C-terminal of the F8V$_L$ is fused to the N-terminal of the IL2, the C-terminal of the IL2 is fused to the N-terminal of the GMCSF, thereby forming a protein molecule IL12b-IL12a-F8V$_H$-L19V$_L$-L19V$_H$-F8V$_L$-IL2-GMCSF.

For example, the structure of the protein molecule may be as follows: the C-terminal of the IL12b is fused to the N-terminal of the IL12a, the C-terminal of the IL12a is fused to the N-terminal of the L19V$_H$, the C-terminal of the L19V$_H$ is fused to the N-terminal of the NHS76V$_L$, the C-terminal of the NHS76V$_L$ is fused to the N-terminal of the NHS76V$_H$, the C-terminal of the NHS76V$_H$ is fused to the N-terminal of the L19V$_L$, the C-terminal of the L19V$_L$ is fused to the N-terminal of the IL2, the C-terminal of the IL2 is fused to the N-terminal of the GMCSF, thereby forming a protein molecule IL12b-IL12a-L19V$_H$-NHS76V$_L$-NHS76V$_H$-L19V$_L$-IL2-GMCSF.

For example, the structure of the protein molecule may be as follows: the C-terminal of the IL12b is fused to the N-terminal of the IL12a, the C-terminal of the IL12a is fused to the N-terminal of the L19V$_H$, the C-terminal of the L19V$_H$ is fused to the N-terminal of the F8V$_L$, the C-terminal of the F8V$_L$ is fused to the N-terminal of the F8V$_H$, the C-terminal of the F8V$_H$ is fused to the N-terminal of the L19V$_L$, the C-terminal of the L19V$_L$ is fused to the N-terminal of the IL2, the C-terminal of the IL2 is fused to the N-terminal of the GMCSF, thereby forming a protein molecule IL12b-IL12a-L19V$_H$-F8V$_L$-F8V$_H$-L19V$_L$-IL2-GMCSF.

For example, the structure of the protein molecule may be as follows: the C-terminal of the IL12b is fused to the N-terminal of the IL12a, the C-terminal of the IL12a is fused to the N-terminal of the IL2, the C-terminal of the IL2 is fused to the N-terminal of the NHS76V$_H$, the C-terminal of the NHS76V$_H$ is fused to the N-terminal of the F8V$_L$, the C-terminal of the F8V$_L$ is fused to the N-terminal of the F8V$_H$, the C-terminal of the F8V$_H$ is fused to the N-terminal of the NHS76V$_L$, the C-terminal of the NHS76V$_L$ is fused to the N-terminal of the GMCSF, thereby forming a protein molecule IL12b-IL12a-IL2-NHS76V$_H$-F8V$_L$-F8V$_H$-NHS76V$_L$-GMCSF.

For example, the structure of the protein molecule may be as follows: the C-terminal of the IL12b is fused to the N-terminal of the IL12a, the C-terminal of the IL12a is fused to the N-terminal of the IL2, the C-terminal of the IL2 is fused to the N-terminal of the F8V$_H$, the C-terminal of the F8V$_H$ is fused to the N-terminal of the F8V$_L$, the C-terminal of the F8V$_L$ is fused to the N-terminal of the F8V$_H$, the C-terminal of the F8V$_H$ is fused to the N-terminal of the F8V$_L$, the C-terminal of the F8V$_L$ is fused to the N-terminal of the GMCSF, thereby forming a protein molecule IL12b-IL12a-IL2-F8V$_H$-F8V$_L$-F8V$_H$-F8V$_L$-GMCSF.

For example, the structure of the protein molecule may be as follows: the C-terminal of the IL12b is fused to the N-terminal of the IL12a, the C-terminal of the IL12a is fused to the N-terminal of the IL2, the C-terminal of the IL2 is fused to the N-terminal of the GMCSF, the C-terminal of the GMCSF is fused to the N-terminal of the NHS76V$_H$, the C-terminal of the NHS76V$_H$ is fused to the N-terminal of the F8V$_L$, the C-terminal of the F8V$_L$ is fused to the N-terminal of the F8V$_H$, the C-terminal of the F8V$_H$ is fused to the N-terminal of the NHS76V$_L$, thereby forming a protein molecule IL12b-IL12a-IL2-GMCSF-NHS76V$_H$-F8V$_L$-F8V$_H$-NHS76V$_L$.

For example, the structure of the protein molecule may be as follows: the C-terminal of the IL12b is fused to the N-terminal of the IL12a, the C-terminal of the IL12a is fused to the N-terminal of the IL2, the C-terminal of the IL2 is fused to the N-terminal of the GMCSF, the C-terminal of the GMCSF is fused to the N-terminal of the F8V$_H$, the C-terminal of the F8V$_H$ is fused to the N-terminal of the F8V$_L$, the C-terminal of the F8V$_L$ is fused to the N-terminal of the F8V$_H$, the C-terminal of the F8V$_H$ is fused to the N-terminal of the F8V$_L$, thereby forming a protein molecule IL12b-IL12a-IL2-GMCSF-F8V$_H$-F8V$_L$-F8V$_H$-F8V$_L$.

For example, the structure of the protein molecule may be as follows: the C-terminal of the IL12b is fused to the N-terminal of the IL12a, the C-terminal of the IL12a is fused to the N-terminal of the L19V$_H$, the C-terminal of the L19V$_H$ is fused to the N-terminal of the L19V$_L$, the C-terminal of the L19V$_L$ is fused to the N-terminal of the L19V$_H$, the C-terminal of the L19V$_H$ is fused to the N-terminal of the L19V$_L$, the C-terminal of the L19V$_L$ is fused to the N-terminal of the GMCSF, the C-terminal of the GMCSF is fused to the N-terminal of the IL2, thereby forming a protein molecule IL12b-IL12a-L19V$_H$-L19V$_L$-L19V$_H$-L19V$_L$-GMCSF-IL2.

For example, the structure of the protein molecule may be as follows: the C-terminal of the IL12b is fused to the N-terminal of the IL12a, the C-terminal of the IL12a is fused to the N-terminal of the NHS76V$_H$, the C-terminal of the NHS76V$_H$ is fused to the N-terminal of the NHS76V$_L$, the C-terminal of the NHS76V$_L$ is fused to the N-terminal of the NHS76V$_H$, the C-terminal of the NHS76V$_H$ is fused to the N-terminal of the NHS76V$_L$, the C-terminal of the NHS76V$_L$ is fused to the N-terminal of the GMCSF, the C-terminal of the GMCSF is fused to the N-terminal of the IL2, thereby forming a protein molecule IL12b-IL12a-NHS76V$_H$-NHS76V$_L$-NHS76V$_H$-NHS76V$_L$-GMCSF-IL2.

For example, the structure of the protein molecule may be as follows: the C-terminal of the IL12b is fused to the N-terminal of the IL12a, the C-terminal of the IL12a is fused to the N-terminal of the NHS76V$_H$, the C-terminal of the NHS76V$_H$ is fused to the N-terminal of the F8V$_L$, the C-terminal of the F8V$_L$ is fused to the N-terminal of the F8V$_H$, the C-terminal of the F8V$_H$ is fused to the N-terminal of the NHS76V$_L$, the C-terminal of the NHS76V$_L$ is fused to the N-terminal of the GMCSF, the C-terminal of the GMCSF is fused to the N-terminal of the IL2, thereby forming a protein molecule IL12b-IL12a-NHS76V$_H$-F8V$_L$-F8V$_H$-NHS76V$_L$-GMCSF-112.

In the present application, the protein molecule may include any one selected from amino acid sequences as set forth in the group consisting of: SEQ ID NOs: 49-71.

For example, the structure of the protein molecule may be as follows: the C-terminal of the mIL12b is fused to the N-terminal of the mIL12a, the C-terminal of the mIL12a is fused to the N-terminal of the mL19$V_H$, the C-terminal of the mL19$V_H$ is fused to the N-terminal of the mL19$V_L$, the C-terminal of the mL19$V_L$ is fused to the N-terminal of the mL19$V_H$, the C-terminal of the mL19$V_H$ is fused to the N-terminal of the mL19$V_L$, the C-terminal of the mL19$V_L$ is fused to the N-terminal of the mIL2, the C-terminal of the mIL2 is fused to the N-terminal of the mGMCSF, thereby forming a protein molecule mIL12b-mIL12a-mL19$V_H$-mL19$V_L$-mL19$V_H$-mL19$V_L$-mIL2-mGMCSF (with an amino acid sequence that may be as set forth in SEQ ID NO. 49).

For example, the structure of the protein molecule may be as follows: the C-terminal of the mIL12b is fused to the N-terminal of the mIL12a, the C-terminal of the mIL12a is fused to the N-terminal of the mF8$V_H$, the C-terminal of the mF8$V_H$ is fused to the N-terminal of the mF8$V_L$, the C-terminal of the mF8$V_L$ is fused to the N-terminal of the mF8$V_H$, the C-terminal of the mF8$V_H$ is fused to the N-terminal of the mF8$V_L$, the C-terminal of the mF8$V_L$ is fused to the N-terminal of the mIL2, the C-terminal of the mIL2 is fused to the N-terminal of the mGMCSF, thereby forming a protein molecule mIL12b-mIL12a-mF8$V_H$-mF8$V_L$-mF8$V_H$-mF8$V_L$-mIL2-mGMCSF (with an amino acid sequence that may be as set forth in SEQ ID NO. 50).

For example, the structure of the protein molecule may be as follows: the C-terminal of the mIL12b is fused to the N-terminal of the mIL12a, the C-terminal of the mIL12a is fused to the N-terminal of the mNHS76$V_H$, the C-terminal of the mNHS76$V_H$ is fused to the N-terminal of the mNHS76$V_L$, the C-terminal of the mNHS76$V_L$ is fused to the N-terminal of the mNHS76$V_H$, the C-terminal of the mNHS76$V_H$ is fused to the N-terminal of the mNHS76$V_L$, the C-terminal of the mNHS76$V_L$ is fused to the N-terminal of the mIL2, the C-terminal of the mIL2 is fused to the N-terminal of the mGMCSF, thereby forming a protein molecule mIL12b-mIL12a-mNHS76$V_H$-mNHS76$V_L$-mNHS76$V_H$-mNHS76$V_L$-mIL2-mGMCSF (with an amino acid sequence that may be as set forth in SEQ ID NO. 51).

For example, the structure of the protein molecule may be as follows: the C-terminal of the mIL12b is fused to the N-terminal of the mIL12a, the C-terminal of the mIL12a is fused to the N-terminal of the mNHS76$V_H$, the C-terminal of the mNHS76$V_H$ is fused to the N-terminal of the F8$V_L$, the C-terminal of the F8$V_L$ is fused to the N-terminal of the F8$V_H$, the C-terminal of the F8$V_H$ is fused to the N-terminal of the mNHS76$V_L$, the C-terminal of the mNHS76$V_L$ is fused to the N-terminal of the mIL2, the C-terminal of the mIL2 is fused to the N-terminal of the mGMCSF, thereby forming a protein molecule mIL12b-mIL12a-mNHS76$V_H$-mF8$V_L$-mF8$V_H$-mNHS76$V_L$-mIL2-mGMCSF (with an amino acid sequence that may be as set forth in SEQ ID NO. 52).

For example, the structure of the protein molecule may be as follows: the C-terminal of the mIL12b is fused to the N-terminal of the mIL12a, the C-terminal of the mIL12a is fused to the N-terminal of the mNHS76$V_H$, the C-terminal of the mNHS76$V_H$ is fused to the N-terminal of the mL19$V_L$, the C-terminal of the mL19$V_L$ is fused to the N-terminal of the mL19$V_H$, the C-terminal of the mL19$V_H$ is fused to the N-terminal of the mNHS76$V_L$, the C-terminal of the mNHS76$V_L$ is fused to the N-terminal of the mIL2, the C-terminal of the mIL2 is fused to the N-terminal of the mGMCSF, thereby forming a protein molecule mIL12b-mIL12a-mNHS76$V_H$-mL19$V_L$-mL19$V_H$-mNHS76$V_L$-mIL2-mGMCSF (with an amino acid sequence that may be as set forth in SEQ ID NO. 53).

For example, the structure of the protein molecule may be as follows: the C-terminal of the mIL12b is fused to the N-terminal of the mIL12a, the C-terminal of the mIL12a is fused to the N-terminal of the mF8$V_H$, the C-terminal of the mF8$V_H$ is fused to the N-terminal of the mNHS76$V_L$, the C-terminal of the mNHS76$V_L$ is fused to the N-terminal of the mNHS76$V_H$, the C-terminal of the mNHS76$V_H$ is fused to the N-terminal of the mF8$V_L$, the C-terminal of the mF8$V_L$ is fused to the N-terminal of the mIL2, the C-terminal of the mIL2 is fused to the N-terminal of the mGMCSF, thereby forming a protein molecule mIL12b-mIL12a-mF8$V_H$-mNHS76$V_L$-mNHS76$V_H$-mF8$V_L$-mIL2-mGMCSF (with an amino acid sequence that may be as set forth in SEQ ID NO. 54).

For example, the structure of the protein molecule may be as follows: the C-terminal of the mIL12b is fused to the N-terminal of the mIL12a, the C-terminal of the mIL12a is fused to the N-terminal of the mF8$V_H$, the C-terminal of the mF8$V_H$ is fused to the N-terminal of the mL19$V_L$, the C-terminal of the mL19$V_L$ is fused to the N-terminal of the mL19$V_H$, the C-terminal of the mL19$V_H$ is fused to the N-terminal of the mF8$V_L$, the C-terminal of the mF8$V_L$ is fused to the N-terminal of the mIL2, the C-terminal of the mIL2 is fused to the N-terminal of the mGMCSF, thereby forming a protein molecule mIL12b-mIL12a-mF8$V_H$-mL19$V_L$-mL19$V_H$-mF8$V_L$-mIL2-mGMCSF (with an amino acid sequence that may be as set forth in SEQ ID NO. 55).

For example, the structure of the protein molecule may be as follows: the C-terminal of the mIL12b is fused to the N-terminal of the mIL12a, the C-terminal of the mIL12a is fused to the N-terminal of the mL19$V_H$, the C-terminal of the mL19$V_H$ is fused to the N-terminal of the mNHS76$V_L$, the C-terminal of the mNHS76$V_L$ is fused to the N-terminal of the mNHS76$V_H$, the C-terminal of the mNHS76$V_H$ is fused to the N-terminal of the mL19$V_L$, the C-terminal of the mL19$V_L$ is fused to the N-terminal of the mIL2, the C-terminal of the mIL2 is fused to the N-terminal of the mGMCSF, thereby forming a protein molecule mIL12b-mIL12a-mL19$V_H$-mNHS76$V_L$-mNHS76$V_H$-mL19$V_L$-mIL2-mGMCSF (with an amino acid sequence that may be as set forth in SEQ ID NO. 56).

For example, the structure of the protein molecule may be as follows: the C-terminal of the mIL12b is fused to the N-terminal of the mIL12a, the C-terminal of the mIL12a is fused to the N-terminal of the mL19$V_H$, the C-terminal of the mL19$V_H$ is fused to the N-terminal of the mF8$V_L$, the C-terminal of the mF8$V_L$ is fused to the N-terminal of the mF8$V_H$, the C-terminal of the mF8$V_H$ is fused to the N-terminal of the mL19$V_L$, the C-terminal of the mL19$V_L$ is fused to the N-terminal of the mIL2, the C-terminal of the mIL2 is fused to the N-terminal of the mGMCSF, thereby forming a protein molecule mIL12b-mIL12a-mL19$V_H$-mF8$V_L$-mF8$V_H$-mL19$V_L$-mIL2-mGMCSF (with an amino acid sequence that may be as set forth in SEQ ID NO. 57).

For example, the structure of the protein molecule may be as follows: the C-terminal of the mIL12b is fused to the N-terminal of the mIL12a, the C-terminal of the mIL12a is fused to the N-terminal of the mIL2, the C-terminal of the mIL2 is fused to the N-terminal of the mNHS76$V_H$, the C-terminal of the mNHS76$V_H$ is fused to the N-terminal of the mF8$V_L$, the C-terminal of the mF8$V_L$ is fused to the N-terminal of the mF8V$_H$, the C-terminal of the mF8V$_H$ is fused to the N-terminal of the mNHS76V$_L$, the C-terminal of the mNHS76V$_L$ is fused to the N-terminal of the mGMCSF, thereby forming a protein molecule mIL12b-mIL12a-mIL2-mNHS76V$_H$-mF8V$_L$-mF8V$_H$-mNHS76V$_L$-mGMCSF (with an amino acid sequence that may be as set forth in SEQ ID NO. 58).

For example, the structure of the protein molecule may be as follows: the C-terminal of the mIL12b is fused to the N-terminal of the mIL12a, the C-terminal of the mIL12a is fused to the N-terminal of the mIL2, the C-terminal of the mIL2 is fused to the N-terminal of the mF8V$_H$, the C-terminal of the mF8V$_H$ is fused to the N-terminal of the mF8V$_L$, the C-terminal of the mF8V$_L$ is fused to the N-terminal of the mF8V$_H$, the C-terminal of the mF8V$_H$ is fused to the N-terminal of the mF8V$_L$, the C-terminal of the mF8V$_L$ is fused to the N-terminal of the mGMCSF, thereby forming a protein molecule mIL12b-mIL12a-mIL2-mF8V$_H$-mF8V$_L$-mF8V$_H$-mF8V$_L$-mGMCSF (with an amino acid sequence that may be as set forth in SEQ ID NO. 59).

For example, the structure of the protein molecule may be as follows: the C-terminal of the mIL12b is fused to the N-terminal of the mIL12a, the C-terminal of the mIL12a is fused to the N-terminal of the mIL2, the C-terminal of the mIL2 is fused to the N-terminal of the mGMCSF, the C-terminal of the mGMCSF is fused to the N-terminal of the mNHS76V$_H$, the C-terminal of the mNHS76V$_H$ is fused to the N-terminal of the mF8V$_L$, the C-terminal of the mF8V$_L$ is fused to the N-terminal of the mF8V$_H$, the C-terminal of the mF8V$_H$ is fused to the N-terminal of the mNHS76V$_L$, thereby forming a protein molecule mIL12b-mIL12a-mIL2-mGMCSF-mNHS76V$_H$-mF8V$_L$-mF8V$_H$-mNHS76V$_L$ (with an amino acid sequence that may be as set forth in SEQ ID NO. 60).

For example, the structure of the protein molecule may be as follows: the C-terminal of the mIL12b is fused to the N-terminal of the mIL12a, the C-terminal of the mIL12a is fused to the N-terminal of the mIL2, the C-terminal of the mIL2 is fused to the N-terminal of the mGMCSF, the C-terminal of the mGMCSF is fused to the N-terminal of the mF8V$_H$, the C-terminal of the mF8V$_H$ is fused to the N-terminal of the mF8V$_L$, the C-terminal of the mF8V$_L$ is fused to the N-terminal of the mF8V$_H$, the C-terminal of the mF8V$_H$ is fused to the N-terminal of the mF8V$_L$, thereby forming a protein molecule mIL12b-mIL12a-mIL2-mGMCSF-mF8V$_H$-mF8V$_L$-mF8V$_H$-mF8V$_L$ (with an amino acid sequence that may be as set forth in SEQ ID NO. 61).

For example, the structure of the protein molecule may be as follows: the C-terminal of the hIL12b is fused to the N-terminal of the hIL12a, the C-terminal of the hIL12a is fused to the N-terminal of the hL19V$_H$, the C-terminal of the hL19V$_H$ is fused to the N-terminal of the hL19V$_L$, the C-terminal of the hL19V$_L$ is fused to the N-terminal of the hL19V$_H$, the C-terminal of the hL19V$_H$ is fused to the N-terminal of the hL19V$_L$, the C-terminal of mL19V$_L$ is fused to the N-terminal of the hIL2, the C-terminal of hIL2 is fused to the N-terminal of the hGMCSF, thereby forming a protein molecule hIL12b-hIL12a-hL19V$_H$-hL19V$_L$-hL19V$_H$-hL19V$_L$-hIL2-hGMCSF (with an amino acid sequence that may be as set forth in SEQ ID NO. 62).

For example, the structure of the protein molecule may be as follows: the C-terminal of the hIL12b is fused to the N-terminal of the hIL12a, the C-terminal of the hIL12a is fused to the N-terminal of the hNHS76V$_H$, the C-terminal of the hNHS76V$_H$ is fused to the N-terminal of the hNHS76V$_L$, the C-terminal of the hNHS76V$_L$ is fused to the N-terminal of the hNHS76V$_H$, the C-terminal of the hNHS76V$_H$ is fused to the N-terminal of the hNHS76V$_L$, the C-terminal of the hNHS76V$_L$ is fused to the N-terminal of the hIL2, the C-terminal of the hIL2 is fused to the N-terminal of the hGMCSF, thereby forming a protein molecule hIL12b-hIL12a-hNHS76V$_H$-hNHS76V$_L$-hNHS76V$_H$-hNHS76V$_L$-hIL2-hGMCSF (with an amino acid sequence that may be as set forth in SEQ ID NO. 63).

For example, the structure of the protein molecule may be as follows: the C-terminal of the hIL12b is fused to the N-terminal of the hIL12a, the C-terminal of the hIL12a is fused to the N-terminal of the hNHS76V$_H$, the C-terminal of the hNHS76V$_H$ is fused to the N-terminal of the hF8V$_L$, the C-terminal of the hF8V$_L$ is fused to the N-terminal of the hF8V$_H$, the C-terminal of the hF8V$_H$ is fused to the N-terminal of the hNHS76V$_L$, the C-terminal of the hNHS76V$_L$ is fused to the N-terminal of the hIL2, the C-terminal of the hIL2 is fused to the N-terminal of the hGMCSF, thereby forming a protein molecule hIL12b-hIL12a-hNHS76V$_H$-hF8V$_L$-hF8V$_H$-hNHS76V$_L$-hIL2-hGMCSF (with an amino acid sequence that may be as set forth in SEQ ID NO. 64).

For example, the structure of the protein molecule may be as follows: the C-terminal of the hIL12b is fused to the N-terminal of the hIL12a, the C-terminal of the hIL12a is fused to the N-terminal of the hIL2, the C-terminal of the hIL2 is fused to the N-terminal of the hNHS76V$_H$, the C-terminal of the hNHS76V$_H$ is fused to the N-terminal of the hF8V$_L$, the C-terminal of the hF8V$_L$ is fused to the N-terminal of the hF8V$_H$, the C-terminal of the hF8V$_H$ is fused to the N-terminal of the hNHS76V$_L$, the C-terminal of the hNHS76V$_L$ is fused to the N-terminal of the hGMCSF, thereby forming a protein molecule hIL12b-hIL12a-hIL2-hNHS76V$_H$-hF8V$_L$-hF8V$_H$-hNHS76V$_L$-hGMCSF (with an amino acid sequence that may be as set forth in SEQ ID NO. 65).

For example, the structure of the protein molecule may be as follows: the C-terminal of the hIL12b is fused to the N-terminal of the hIL12a, the C-terminal of the hIL12a is fused to the N-terminal of the hIL2, the C-terminal of the hIL2 is fused to the N-terminal of the hF8V$_H$, the C-terminal of the hF8V$_H$ is fused to the N-terminal of the hF8V$_L$, the C-terminal of the hF8V$_L$ is fused to the N-terminal of the hF8V$_H$, the C-terminal of the hF8V$_H$ is fused to the N-terminal of the hF8V$_L$, the C-terminal of the hF8V$_L$ is fused to the N-terminal of the hGMCSF, thereby forming a protein molecule hIL12b-hIL12a-hIL2-hF8V$_H$-hF8V$_L$-hF8V$_H$-hF8V$_L$-hGMCSF (with an amino acid sequence that may be as set forth in SEQ ID NO. 66).

For example, the structure of the protein molecule may be as follows: the C-terminal of the hIL12b is fused to the N-terminal of the hIL12a, the C-terminal of the hIL12a is fused to the N-terminal of the hL19V$_H$, the C-terminal of the hL19V$_H$ is fused to the N-terminal of the hL19V$_L$, the C-terminal of the hL19V$_L$ is fused to the N-terminal of the hL19V$_H$, the C-terminal of the hL19V$_H$ is fused to the N-terminal of the hL19V$_L$, the C-terminal of the hL19V$_L$ is fused to the N-terminal of the hGMCSF, the C-terminal of the hGMCSF is fused to the N-terminal of the hIL2, thereby forming a protein molecule hIL12b-hIL12a-hL19V$_H$-hL19V$_L$-hL19V$_H$-hL19V$_L$-hGMCSF-hIL2 (with an amino acid sequence that may be as set forth in SEQ ID NO. 67).

For example, the structure of the protein molecule may be as follows: the C-terminal of the hIL12b is fused to the N-terminal of the hIL12a, the C-terminal of the hIL12a is fused to the N-terminal of the hNHS76V$_H$, the C-terminal of the hNHS76V$_H$ is fused to the N-terminal of the hNHS76V$_L$, the C-terminal of the hNHS76V$_L$ is fused to the N-terminal of the hNHS76V$_H$, the C-terminal of the hNHS76V$_H$ is fused to the N-terminal of the hNHS76V$_L$, the C-terminal of the hNHS76V$_L$ is fused to the N-terminal of the hGMCSF, the C-terminal of the hGMCSF is fused to the N-terminal of the hIL2, thereby forming a protein molecule hIL12b-hIL12a-hNHS76V$_H$-hNHS76V$_L$-hNHS76V$_H$-hNHS76V$_L$-hGMCSF-hIL2 (with an amino acid sequence that may be as set forth in SEQ ID NO. 68).

For example, the structure of the protein molecule may be as follows: the C-terminal of the hIL12b is fused to the N-terminal of the hIL12a, the C-terminal of the hIL12a is fused to the N-terminal of the hNHS76V$_H$, the C-terminal of the hNHS76V$_H$ is fused to the N-terminal of the hF8V$_L$, the C-terminal of the hF8V$_L$ is fused to the N-terminal of the hF8V$_H$, the C-terminal of the hF8V$_H$ is fused to the N-terminal of the hNHS76V$_L$, the C-terminal of the hNHS76V$_L$ is fused to the N-terminal of the hGMCSF, the C-terminal of the hGMCSF is fused to the N-terminal of the hIL2, thereby forming a protein molecule hIL12b-hIL12a-hNHS76V$_H$-hF8V$_L$-hF8V$_H$-hNHS76V$_L$-hGMCSF-hIL2 (with an amino acid sequence that may be as set forth in SEQ ID NO. 69).

In the present application, said mIL12b-mIL12a-mL19V$_H$-mL19V$_L$-mL19V$_H$-mL19V$_L$-mIL2-mGMCSF, mIL12b-mIL12a-mF8V$_H$-mF8V$_L$-mF8V$_H$-mF8V$_L$-mIL2-mGMCSF, mIL12b-mIL12a-mNHS76V$_H$-mNHS76V$_L$-mNHS76V$_H$-mNHS76V$_L$-mIL2-mGMCSF, mIL12b-mIL12a-mNHS76V$_H$-mF8V$_L$-mF8V$_H$-mNHS76V$_L$-mIL2-mGMCSF, mIL12b-mIL12a-mNHS76V$_H$-mL19V$_L$-mL19V$_H$-mNHS76V$_L$-mIL2-mGMCSF, mIL12b-mIL12a-mF8V$_H$-mNHS76V$_L$-mNHS76V$_H$-mF8V$_L$-mIL2-mGMCSF, mIL12b-mIL12a-mF8V$_H$-mL19V$_L$-mL19V$_H$-mF8V$_L$-mIL2-mGMCSF, mIL12b-mIL12a-mL19V$_H$-mNHS76V$_L$-mNHS76V$_H$-mL19V$_L$-mIL2-mGMCSF, mIL12b-mIL12a-mL19V$_H$-mF8V$_L$-mF8V$_H$-mL19V$_L$-mIL2-mGMCSF, mIL12b-mIL12a-mIL2-mNHS76V$_H$-mF8V$_L$-mF8V$_H$-mNHS76V$_L$-mGMCSF, mIL12b-mIL12a-mIL2-mF8V$_H$-mF8V$_L$-mF8V$_H$-mF8V$_L$-mGMCSF, mIL12b-mIL12a-mIL2-mGMCSF-mNHS76V$_H$-mF8V$_L$-mF8V$_H$-mNHS76V$_L$, mIL12b-mIL12a-mIL2-mGMCSF-mF8V$_H$-mF8V$_L$-mF8V$_H$-mF8V$_L$, hIL12b-hIL12a-hL19V$_H$-hL19V$_L$-hL19V$_H$-hL19V$_L$-hIL2-hGMCSF, hIL12b-hIL12a-hNHS76V$_H$-hNHS76V$_L$-hNHS76V$_H$-hNHS76V$_L$-hIL2-hGMCSF, hIL12b-hIL12a-hNHS76V$_H$-hF8V$_L$-hF8V$_H$-hNHS76V$_L$-hIL2-hGMCSF, hIL12b-hIL12a-hNHS76V$_H$-hF8V$_L$-hF8V$_H$-hNHS76V$_L$-hIL2-hGMCSF, hIL12b-hIL12a-hIL2-hF8V$_H$-hF8V$_L$-hF8V$_H$-hF8V$_L$-hGMCSF, hIL12b-hIL12a-hL19V$_H$-hL19V$_L$-hL19V$_H$-hL19V$_L$-hGMCSF-hIL2, hIL12b-hIL12a-hNHS76V$_H$-hNHS76V$_L$-hNHS76V$_H$-hNHS76V$_L$-hGMCSF-hIL2, and hIL12b-hIL12a-hNHS76V$_H$-hF8V$_L$-hF8V$_H$-hNHS76V$_L$-hGMCSF-hIL2 may be sequentially referred to as mIL12bIL12aDiaL19IL2GMCSF, mIL12bIL12aDiaF8IL2GMCSF, mIL12bIL12aDiaNHS76IL2GMCSF, mIL12bIL12aDiaNHS76F8IL2GMCSF, mIL12bIL12aDiaNHS76L19IL2GMCSF, mIL12bIL12aDiaF8NHS76IL2GMCSF, mIL12bIL12aDiaF8L19IL2GMCSF, mIL12bIL12aDiaL19NHS76IL2GMCSF, mIL12IL12a-DiaL19F8IL2GMCSF, mIL12bIL12aIL2DiaNHS76F8GMCSF, mIL12bIL12aIL2DiaF8GMCSF, mIL12bIL12aIL2GMCSFDiaNHS76F8, mIL12bIL12aIL2GMCSF-DiaF8, hIL12bIL12aDiaL19IL2GMCSF, hIL12bIL12aDiaNHS76IL2GMCSF, hIL12bIL12aDiaNHS76F8IL2GMCSF, hIL12bIL12aIL2DiaNHS76F8GMCSF, hIL12bIL12aIL2DiaF8GMCSF, hIL12bIL12aDiaL19GMCSFIL2, hIL12bIL12aDiaNHS76GMCSFIL2, hIL12bIL12aDiaNHS76F8GMCSFIL2 for short, respectively.

The protein, polypeptide, and/or amino acid sequence involved in the present application should also be understood to include at least the following range: a variant or homologue that has the same or similar functions as said protein or polypeptide.

In the present application, the variant may be a protein or polypeptide formed by substituting, deleting or adding one or more amino acids in an amino acid sequence of said protein and/or polypeptide (for example, the protein molecule). For example, the functional variant may include a protein or polypeptide with amino acid changes induced by substituting, deleting, and/or inserting at least one amino acid, for example, 1-30, 1-20, or 1-10 amino acids, and for another example, 1, 2, 3, 4, or 5 amino acids. The functional variant may substantially maintain the biological properties of said protein or polypeptide before the changes (for example, substitution, deletion, or addition). For example, the functional variant may maintain at least 60%, 70%, 80%, 90%, or 100% of the biological activities of said protein or polypeptide before the changes.

In the present application, the homologue may be a protein or polypeptide that has at least about 80% (for example, at least about 85%, about 90%, about 91%, about 92%, about 93%, about 94%, about 95%, about 96%, about 97%, about 98%, about 99% or higher) sequence homology with the amino acid sequence of said protein and/or polypeptide (for example, the protein molecule).

In the present application, the homology generally refers to the similarity, resemblance or association between two or more sequences. The "percentage of sequence homology" may be calculated in the following way: comparing two sequences to be aligned in a comparison window, determining in the two sequences the number of positions at which identical nucleic acid bases (for example, A, T, C, G and I) or identical amino acid residues (for example, Ala, Pro, Ser, Thr, Gly, Val, Leu, Ile, Phe, Tyr, Trp, Lys, Arg, His, Asp, Glu, Asn, Gln, Cys, and Met) exist to acquire the number of matching positions; and dividing the number of matching positions by the total number of positions in the comparison window (i.e., the window size), and multiplying a result by 100 to produce the sequence homology percentage. The alignment for determining the sequence homology percentage may be achieved in a variety of ways known in the art, for example, by using publicly available computer software such as BLAST, BLAST-2, ALIGN or Megalign (DNAS-TAR) software. Those skilled in the art may determine appropriate parameters for sequence alignment, including any algorithm required to implement the maximum alignment undergoing comparison, within a full-length sequence range or within a target sequence region. The homology may also be determined by the following methods: FASTA and BLAST. For the description of the FASTA algorithm, a reference may be made to W. R. Pearson and D. J. Lipman, "Improved Tools for Biological Sequence Comparison", Proc. Natl. Acad. Sci.), 85: 2444-2448, 1988; and D. J. Lipman and W. R. Pearson, "Rapid and Sensitive Protein Similarity Searches", Science, 227: 1435-1441, 1989. For the description of the BLAST algorithm, a reference may be made to S. Altschul, W. Gish, W. Miller, E. W. Myers and D. Lipman, "Basic Local Alignment Search Tool", J. Mol. Biol., 215: 403-410, 1990.

In another aspect, the present application provides a nucleotide molecule encoding the defined protein molecule.

In the present application, the nucleotide molecule includes any one selected from nucleotide sequences as set forth in the group consisting of: SEQ ID NOs: 73-112.

In another aspect, the present application provides a vector including the defined nucleotide molecule.

In the present application, methods for constructing vectors and plasmids, such as methods for inserting genes encoding proteins into vectors and plasmids or methods for introducing plasmids into host cells, are well known to those ordinarily skilled in the art and have been described in many publications, including Sambrook, J., Fritsch, E. F. and Maniais, T. (1989) Molecular Cloning: A Laboratory Manual, 2nd edition, Cold spring Harbor Laboratory Press.

In another aspect, the present application provides a cell expressing the defined protein molecule, or including the defined nucleotide molecule, or including the defined vector.

In the present application, the cell may be used to treat a tumor. In the present application, the tumor may include a solid tumor. For example, the tumor may include melanoma.

In another aspect, the present application provides a method for preparing said protein molecule, including the following step: culturing the defined cell.

In the present application, the method may be performed in a situation that the protein molecule may be expressed.

In another aspect, the present application provides a pharmaceutical composition including the defined protein molecule.

In the present application, the pharmaceutical composition may also include a pharmaceutically acceptable carrier. For example, the pharmaceutically acceptable carrier may include a buffer, an antioxidant, a preservative, a low molecular weight polypeptide, a protein, a hydrophilic polymer, an amino acid, a sugar, a chelating agent, a counterion, a metal complex and/or a non-ionic surfactant, etc. For example, the pharmaceutically acceptable carrier may include an excipient. For example, the excipient may be selected from the group consisting of: starch, dextrin, sucrose, lactose, magnesium stearate, calcium sulfate, carboxymethyl, talcum powder, calcium alginate gel, chitosan and nano microspheres, etc. For example, the pharmaceutically acceptable carrier may also be selected from the group consisting of: a pH regulator, an osmotic pressure regulator, a solubilizer and an bacteriostatic agent.

In the present application, the pharmaceutical composition may be formulated for oral administration, intravenous administration, intramuscular administration, in situ administration at a tumor site, inhalation, rectal administration, vaginal administration, transderm al administration, or administration via a subcutaneous depot.

In the present application, the pharmaceutical composition may be used to inhibit tumor growth. For example, the pharmaceutical composition of the present application may inhibit or delay the development or progression of a disease, may reduce the size of a tumor (or even substantially eliminate the tumor) by promoting the expression of cytokines, and/or may alleviate and/or stabilize a disease state.

In the present application, the pharmaceutical composition may include a therapeutically effective amount of the protein molecule, the nucleic acid molecule, the vector and/or the host cell. therapeutically effective amount is a dose required to prevent and/or treat (at least partially treat) a disorder or condition (such as cancer) and/or any complications thereof in a subject suffering from or at risk of developing the disorder or condition.

In another aspect, the present application provides uses of the defined protein molecule and the defined pharmaceutical composition in the preparation of an anti-tumor drug.

The present application provides the protein molecule, the pharmaceutical composition, the nucleic acid molecule, the vector and/or the cell for treating tumors.

The present application provides a method for alleviating or treating a tumor, which may include administering the protein molecule, the pharmaceutical composition, the nucleic acid molecule, the vector and/or the cell to a subject in need thereof.

In the present application, methods for administration may include oral administration, intravenous administration, intramuscular administration, in situ administration at a tumor site, inhalation, rectal administration, vaginal administration, transdermal administration or administration via a subcutaneous depot.

In the present application, the tumor may include a solid tumor. For example, the tumor may include melanoma.

Not wishing to be bound by any particular theory, the following examples are merely to illustrate the protein molecule, preparation methods and uses and the like according to the present application, and are not intended to limit the scope of the present invention.

EXAMPLES

Reagents: DMEM medium, 1640 medium, and fetal bovine serum were purchased from Life Technologies; cell culture flasks and culture plates were purchased from Corning; doxycycline (DOX) was purchased from Shanghai Sangon Biotech Co., Ltd.; puromycin and blasticidin were purchased from Chemicon; restriction endonucleases were purchased from Takara and NEB; ligases were purchased from NEB; DNA polymerases were purchased from Takara; plasmid extraction kits and gel extraction kits were purchased from Omega Biotech; the synthesis of primers was completed by Shanghai Sangon Biotech Co., Ltd.; the gene synthesis was completed by Nanjing GenScript Company; and ELISA kits were purchased from Boster.

Example 1 Preparation of Tumor Cells Expressing Regulatable Proteins 1.1 Construction of First Expression Vector pLentis-CMV-rtTA-IRES-Bsd A DNA sequence of rtTA (GenBank: ALK44378.1) with sites BamHI and EcoRI at both ends were synthesized, and a synthesized product was linked to a pUC57 vector. The pUC57 vector linked to the rtTA was enzyme-digested, with an enzyme digestion system as follows: 6 μg of pUC57 vector plasmid linked to the rtTA, 4 μl of enzyme-digestion buffer, 1 μl of BamHI, and 1 μl of EcoRI were added with water to a total volume of 40 μl, and let stand at 37° C. for 12 hours. An EP tube was taken out and added with 4.4 μl of 10× loading buffer; electrophoresis was performed by using 1% agarose gel; and after the electrophoresis, a rtTA fragment was recovered for later use.

In the EP tube, enzyme digestion was performed on the pLentis-CMV-IRES-Bsd vector, with an enzyme digestion system as follows: 2 μg of pLentis-CMV-IRES-Bsd vector plasmid, 3 μl of enzyme digestion buffer, 1 μl of BamHI and 1 μl of XhoI were added with water to a total volume of 30 and let stand at 37° C. for 12 hours. The EP tube was taken out and added with 3.3 μl of 10× loading buffer; electrophoresis was performed by using 1% agarose gel; and after the electrophoresis, a PTRE-MCS-PGK-PURO vector fragment was recovered for later use.

The pLentis-CMV-IRES-Bsd was linked to the rtTA, with a system as follows: 2 μl of pLentis-CMV-IRES-Bsd, 2 μl of rtTA, 1 μl of ligase buffer, 0.5 μl of T4DNA ligase, and 4.5 μl of water were held at room temperature for linking for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the rtTA fragments were successfully linked into the pLentis-CMV-IRES-Bsd vector was identified by enzyme digestion. Then, the correct vector was sent for sequencing to determine that the first expression vector pLentis-CMV-rtTA-IBES-Bsd was successfully constructed.

1.2 Preparation of Virus of First Expression Vector pLentis-CMV-rtTA-IRES-Bsd

1) The cultured 293FT cells were digested, counted and then plated into a 10 cm culture dish at $3\times10^6$ cells/well, where the volume of culture solution was 10 ml.
2) In the evening of the second day, cellular states were observed, and transfection was performed if the cellular states were in a good condition. Chloroquine was added to the culture plate to a final concentration of 25 µM. A test tube was taken and added with sterile water and the following plasmids (5 µg of pMD2.G+15 µg of pSPAX2+20 µg of pLentis-CMV-rtTA-IRES-Bsd), until the total volume reached 1045 Then 155 µl of 2MCaCl2 was added and mixed well. Finally, 1200 µl of 2×HBS was added by dripping over shaking. After the dripping was completed, a resulting mixture was quickly added to cell culture wells and gently shaken and mixed well.
3) In the morning of the third day, cellular states were observed, and the medium was changed to 10 ml of fresh DMEM medium.
4) In the morning of the fifth day, cellular states were observed. Supernatant in the culture dish was collected and filtered with a 0.45 µm filter, then placed in a high-speed centrifuge tube, and centrifuged at 50,000 g for 2 hours. The supernatant was carefully discarded, and the liquid was sucked to dryness with absorbent paper as much as possible. Then, 500 µl of HBSS was used for resuspension and precipitation. Precipitates were dissolved for 2 hours, then dispensed into small tubes, and stored at −70° C. to obtain the virus of the first expression vector pLentis-CMV-rtTA-IRES-Bsd.

1.3 Infection of B16 Tumor Cells Using the Virus of the First Expression Vector pLentis-CMV-rtTA-IRES-Bsd The cultured mouse melanoma cells B16 were digested, inoculated into a 6-well plate at $10^5$ cells/well, with a culture volume of 1 ml. After 24 hours, 10 µl of the virus of the first expression vector pLentis-CMV-rtTA-IRES-Bsd was added. After the resulting mixture was incubated in an incubator for 24 hours, supernatant was discarded and replaced with fresh medium to continue culturing. After the cells grew all over, the cells were transferred to a culture flask. Blasticidin was added at a concentration suitable for these cells to continue culturing. The medium was changed every two days, and the concentration of the blasticidin was kept at 8 µg/ml. After one week of screening, the survived cells were cells that stably expressed the regulator protein, and these cells were named as B16 (rtTA).

Example 2 Effect of Induced Expression of Green Fluorescent Protein (GFP) on Tumor Growth 2.1 Construction of Regulatable Expression Vector Encoding Green Fluorescent Protein (GFP)

A PCR reaction was conducted with a GFP gene as a template by using primers to amplify GFP genes, where PCR conditions were as listed in the instructions of the PrimeStarHS DNA polymerase. After agarose gel electrophoresis was performed for the PCR, the gel was extracted with a gel extraction kit. Then, enzyme digestion was performed by using BamHI and EcoRI, with an enzyme digestion system as follows: 30 µg of PCR product, 4 µl of digestion buffer, 1 µl of BamHI and 1 µl of EcoRI were added with water until the total volume reached 40 and then let stand at 37° C. for 12 hours. An EP tube was taken out and added with 4.4 µl of 10× loading buffer; electrophoresis was performed by using 1% agarose gel; and after the electrophoresis, a GFP gene fragment was recovered for later use.

Enzyme digestion was performed on a regulatable expression vector, with a system as follows: 2 µg of pLentis-PTRE-MCS-PGK-PURO plasmid, 3 µl of enzyme digestion buffer, 1 µl of BamHI and 1 µl of EcoRI were added with water to a total volume of 30 and let stand at 37° C. for 12 hours. An EP tube was taken out and added with 3.3 µl of 10× loading buffer; electrophoresis was performed by using 1% agarose gel; and after the electrophoresis, a fragment was recovered for later use. The pLentis-PTRE-MCS-PGK-PURO was linked to the GFP, with a linking system including: 2 µl of pLentis-PTRE-MCS-PGK-PURO, 2 µl of GFP, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-CMV-rtTA-IRES-Bsd was successfully constructed.

2.2 Preparation of Cells Regulating and Expressing GFP

A virus of a GFP-expressing vector was prepared with a method the same as that for preparing the virus of the first expression vector, to obtain a virus of a second expression vector pLentis-PTRE-GFP-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-GFP-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were cells capable of regulating and expressing GFP, which were named as B16 (rtTA)-GFP.

2.3 Effect of Regulated Expression of GFP on Tumor Growth

Figure 2:
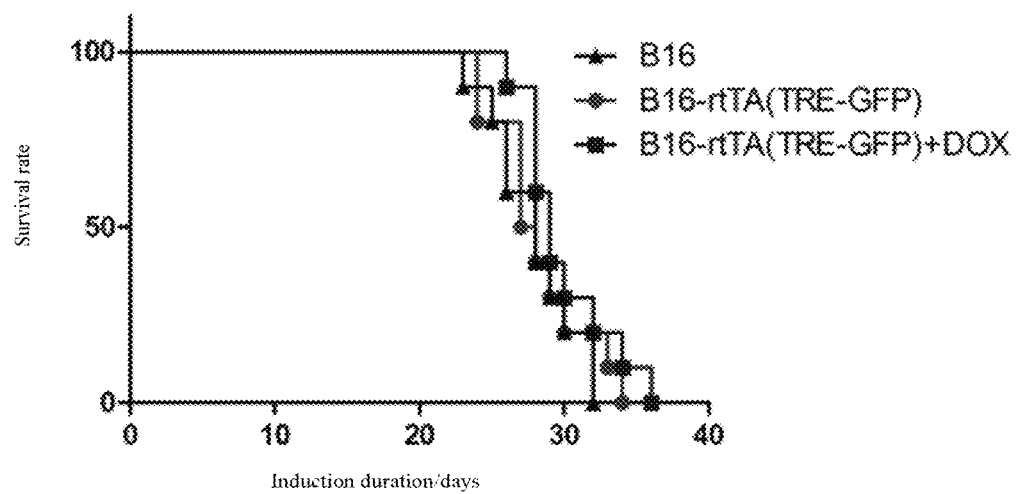
FIG. 2 shows the survival rate of mice in each group.

The cells B16(rtTA)-GFP in a logarithmic growth phase were digested, diluted with HBSS to $2\times10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the tumor growth in the mice was recorded, as shown in FIG. 1. The results showed that the induced expression of GFP had no inhibitory effect on tumor growth (in FIG. 1, each broken line represented the tumor area in one mouse). The survival curve of each group of mice was shown in FIG. 2.

Example 3 Design of Protein Molecule

Figure 3:
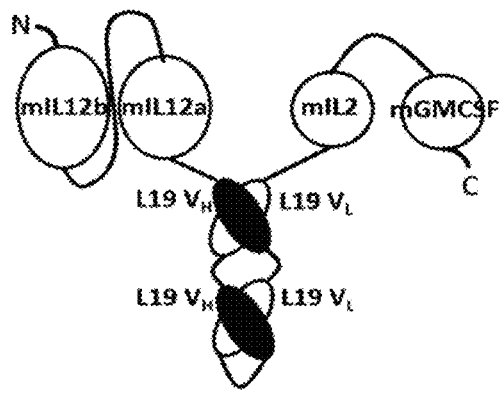
Figure 4:
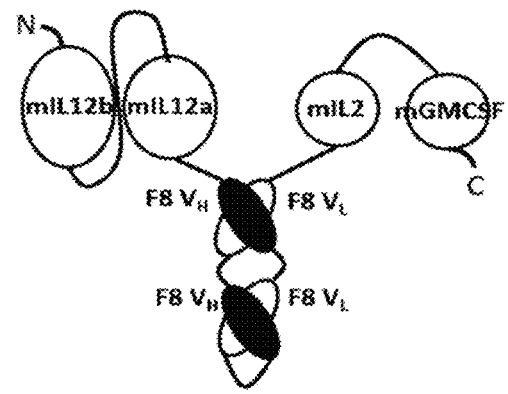
Figure 5:
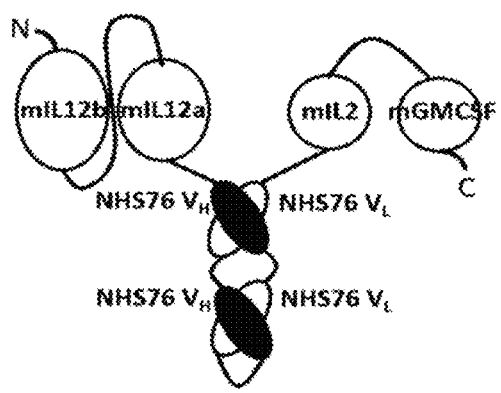
Figure 6:
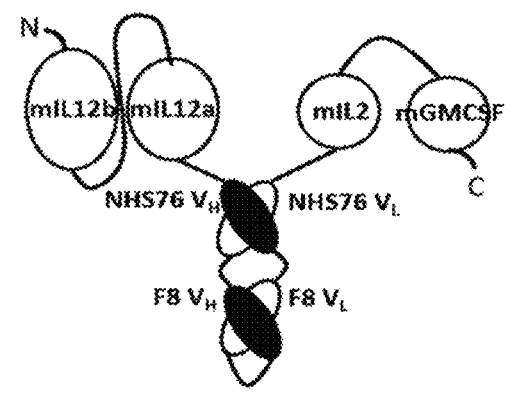
Figure 7:
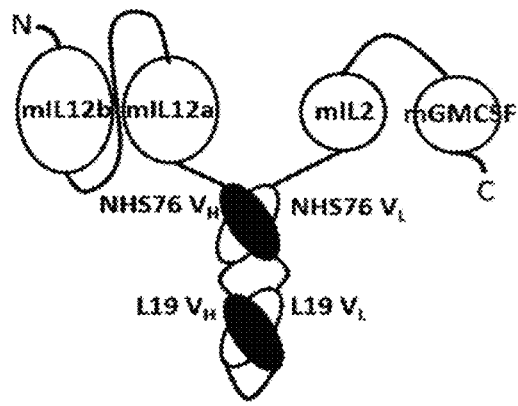
Figure 8:
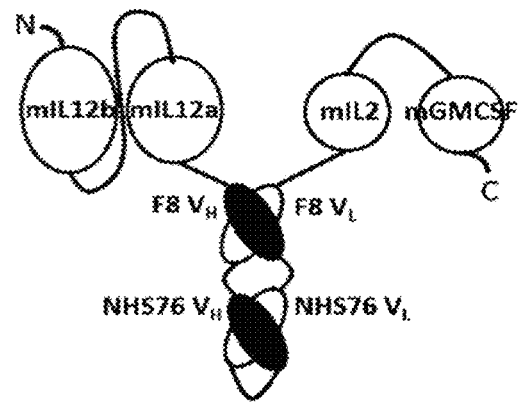
Figure 14:
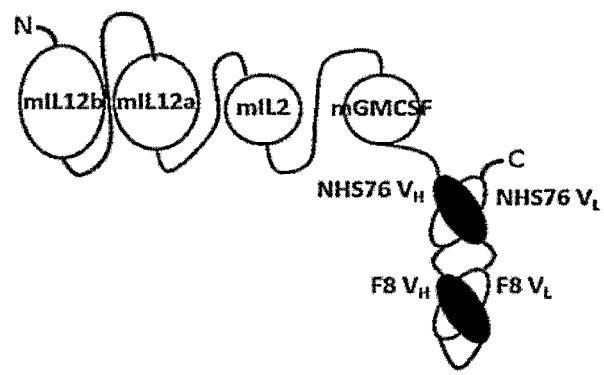
Figure 15:
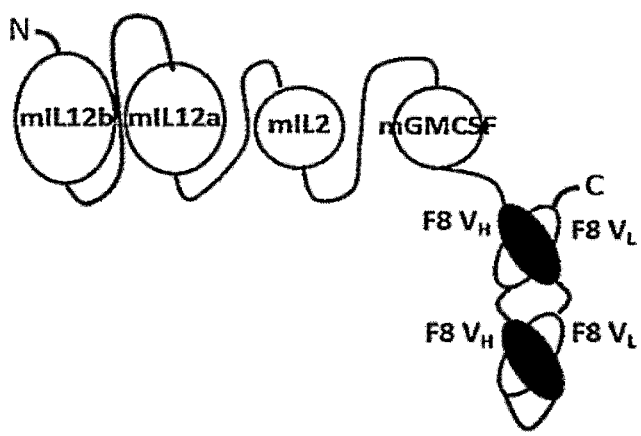
Figure 16:
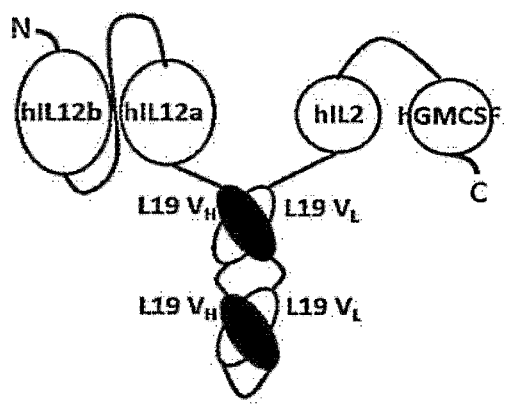
Figure 17:
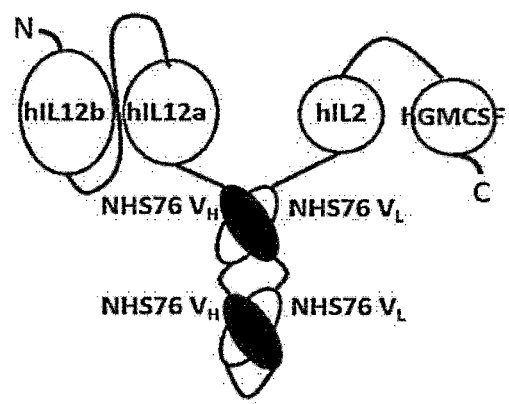
Figure 18:
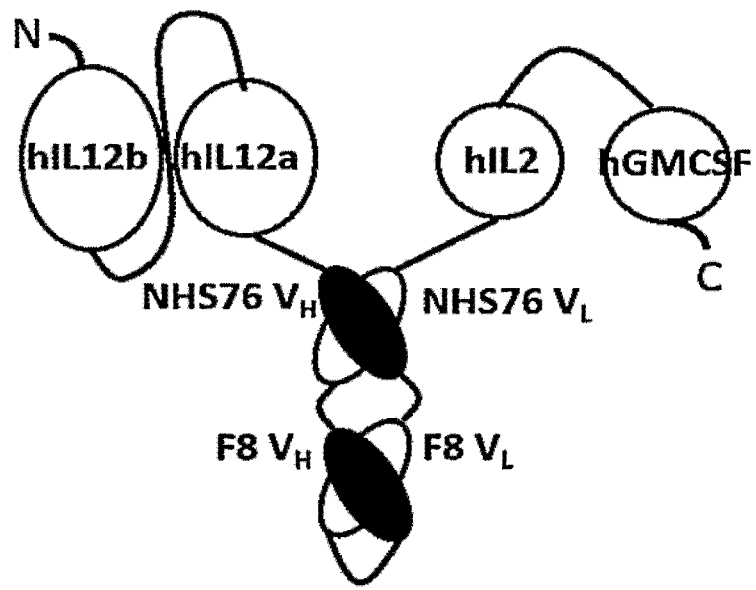
Figure 19:
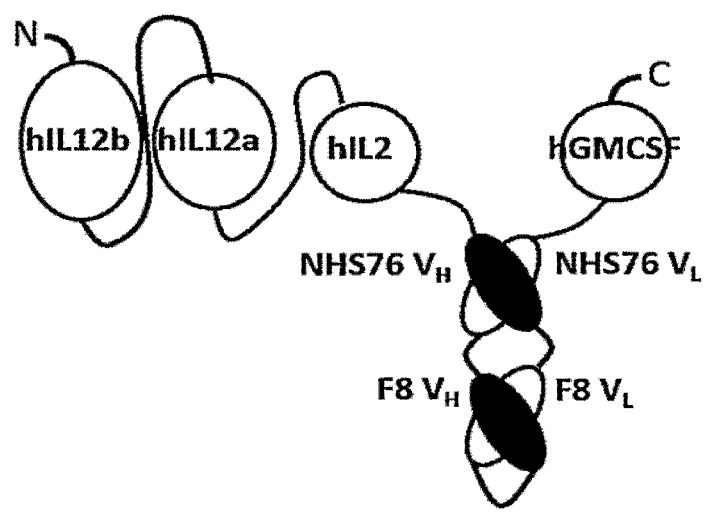
Figure 20:
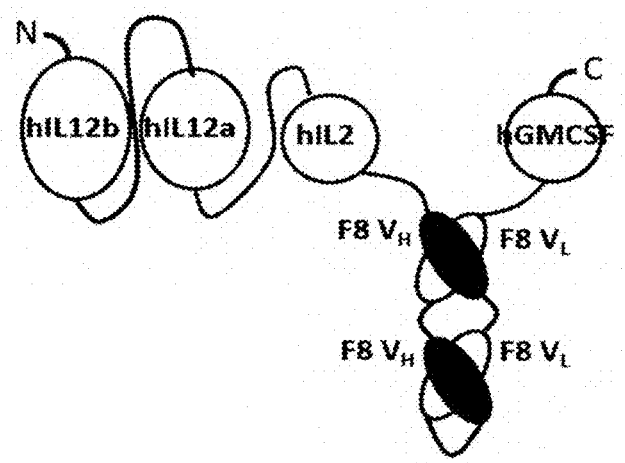

The following protein molecules were designed: mIL12bIL12aDiaL19IL2GMCSF (with a structure as shown in FIG. 3), mIL12bIL12aDiaF8IL2GMCSF (with a structure as shown in FIG. 4), mIL12bIL12aDiaNHS76IL2GMCSF (with a structure as shown in FIG. 5), mIL12bIL12aDiaNHS76F8IL2GMCSF (with a structure as shown in FIG. 6), mIL12IL12aDiaNHS76L19IL2GMCSF (with a structure as shown in FIG. 7), mIL12IL12aDiaF8NHS76IL2GMCSF (with a structure as shown in FIG. 8), mIL12IL12aDiaF8L19IL2GMCSF (with a structure as shown in FIG. 9), mIL12bIL12aDiaL19NHS76IL2GMCSF (with a structure as shown in FIG. 10), mIL12IL12aDiaL19F8IL2GMCSF (with a structure as shown in FIG. 11), mIL12bIL12aIL2DiaNHS76F8GMCSF (with a structure as shown in FIG. 12), mIL12IL12aIL2DiaF8GMCSF (with a structure as shown in FIG. 13), mIL12IL12aIL2GMCSFDiaNHS76F8 (with a structure as shown in FIG. 14), mIL12bIL12aIL2GMCSFDiaF8 (with a structure as shown in FIG. 15), hIL12bIL12aDiaL19IL2GMCSF (with a structure as shown in FIG. 16), hIL12bIL12aDiaNHS76IL2GMCSF (with a structure as shown in FIG. 17), hIL12bIL12aDiaNHS76F8IL2GMCSF (with a structure as shown in FIG. 18), hIL12bIL12aIL2DiaF8GMCSF (with a structure as shown in FIG. 20), mIL12IL12aIL2DiaNHS76F8GMCSF-Thr, hIL12IL12a-DiaL19GMCSFIL2, hIL12bIL12aDiaNHS76GMCSFIL2, hIL12bIL12aDiaNHS76F8GMCSFIL2, hIL12bIL12aIL2DiaNHS76F8GMCSF (with a structure as shown in FIG. 19), hIL12bIL12aIL2DiaNHS76F8GMCSF-Thr, mIL12b IL12aIL2GMCSF, mIL12bIL12aGMCSFIL2, mIL12bIL12aIL7GMCSF, mIL12bIL12aIL15GMCSF, mIL12bIL12aIL21GMCSF, mIL12bIL12aIL2FLT3L, mIL12bIL12aIL7FLT3L, mIL12bIL12aIL15FLT3L, mIL12bIL12aIL21FLT3L, hIL12bIL12aIL2GMCSF, IL12bIL12aIL7GMCSF, hIL12bIL12aIL15GMCSF, hIL12bIL12aIL21GMCSF, hIL12bIL12aIL2FLT3L, hIL12bIL12aIL7FLT3L, hIL12bIL12aIL15FLT3L, hIL12bIL12aIL21FLT3L.

For example, FIG. 3 shows the structure of the protein molecule mIL12bIL12aDiaL19IL2GMCSF, where "m" in the formula represents that the cytokines are derived from mice. The protein molecule includes one polypeptide chain, wherein mIL12bIL12aDiaL19IL2GMCSF represents that the interleukin IL12b, the interleukin IL12a, the targeting moieties $L19V_H$, $L19V_L$, $L19V_H$, and $L19V_L$, the interleukin IL2, and the granulocyte macrophage colony stimulating factor (GMCSF) are sequentially included in the polypeptide chain from the N-terminal to the C-terminal; and the targeting moieties in the order of $L19V_H$, $L19V_L$, $L19V_H$, and $L19V_L$ may be represented by DiaL19.

For example, FIG. 4 shows the structure of the protein molecule mIL12bIL12aDiaF8IL2GMCSF, where "m" in the formula represents that the cytokines are derived from mice. The protein molecule includes one polypeptide chain, wherein mIL12bIL12aDiaF8IL2GMCSF represents that the interleukin IL12b, the interleukin IL12a, the targeting moieties $F8V_H$, $F8V_L$, $F8V_H$, and $F8V_L$, the interleukin IL2, and the granulocyte macrophage colony stimulating factor (GMCSF) are sequentially included in the polypeptide chain from the N-terminal to the C-terminal; and the targeting moieties in the order of $F8V_H$, $F8V_L$, $F8V_H$, and $F8V_L$ may be represented by DiaF8.

For example, FIG. 5 shows the structure of the protein molecule mIL12bIL12aDiaNHS76IL2GMCSF, where "m" in the formula represents that the cytokines are derived from mice. The protein molecule includes one polypeptide chain, wherein mIL12bIL12aDiaNHS76IL2GMCSF represents that the interleukin IL12b, the interleukin IL12a, the targeting moieties $NHS76V_H$, $NHS76V_L$, $NHS76V_H$, and $NHS76V_L$, the interleukin IL2, and the granulocyte macrophage colony stimulating factor (GMCSF) are sequentially included in the polypeptide chain from the N-terminal to the C-terminal; and the targeting moieties in the order of $NHS76V_H$, $NHS76V_L$, $NHS76V_H$, and $NHS76V_L$ may be represented by DiaNHS76.

For example, FIG. 6 shows the structure of the protein molecule mIL12bIL12aDiaNHS76F8IL2GMCSF, where "m" in the formula represents that the cytokines are derived from mice. The protein molecule includes one polypeptide chain, wherein mIL12bIL12aDiaNHS76F8IL2GMCSF represents that the interleukin IL12b, the interleukin IL12a, the targeting moieties $NHS76V_H$, $F8V_L$, $F8V_H$, and $NHS76V_L$, the interleukin IL2, and the granulocyte macrophage colony stimulating factor (GMCSF) are sequentially included in the polypeptide chain from the N-terminal to the C-terminal; and the targeting moieties in the order of $NHS76V_H$, $F8V_L$, $F8V_H$, and $NHS76V_L$ may be represented by DiaNHS76F8.

It should be noted that the structures of the protein molecule mIL12bIL12aDiaNHS76L19IL2GMCSF (with a structure as shown in FIG. 7), the protein molecule mIL12bIL12aDiaF8NHS76IL2GMCSF (with a structure as shown in FIG. 8), the protein molecule mIL12bIL12aDiaF8L19IL2GMCSF (with a structure as shown in FIG. 9), and the protein structure mIL12bIL12aDiaL19NHS76IL2GMCSF (with a structure as shown in FIG. 10), and the protein molecule mIL12bIL12aDiaL19F8IL2GMCSF (with a structure as shown in FIG. 11) are similar to the structures of the protein molecules (for example, the protein molecule mIL12bIL12aDiaNHS76F8IL2GMCSF) described above, with a difference only in the targeting moieties. Therefore, the specific structures of these protein molecules will not be repeated here in detail any more.

For example, FIG. 12 shows the structure of a protein molecule mIL12bIL12aIL2DiaNHS76F8GMCSF, where "m" in the formula represents that the cytokines are derived from mice. The protein molecule includes one polypeptide chain, wherein mIL12bIL12aIL2DiaNHS76F8GMCSF represents that the interleukin IL12b, the interleukin IL12a, the interleukin IL2, the targeting moieties $NHS76V_H$, $F8V_L$, $F8V_H$, and $NHS76V_L$, and the granulocyte macrophage colony stimulating factor (GMCSF) are sequentially included in the polypeptide chain from the N-terminal to the C-terminal; and the targeting moieties in the order of $NHS76V_H$, $F8V_L$, $F8V_H$, and $NHS76V_L$ may be represented by DiaNHS76F8.

It should be noted that the structure of the protein molecule mIL12bIL12aIL2DiaF8GMCSF (with the structure as shown in FIG. 13) is similar to the structure of the protein molecule mIL12bIL12aIL2DiaNHS76F8GMCSF, with a difference only in the targeting moieties. Therefore, the specific structure of the protein molecule mIL12bIL12aIL2DiaF8GMCSF will not be repeated here in detail any more.

For example, FIG. 14 shows the structure of a protein molecule mIL12bIL12aIL2GMCSFDiaNHS76F8, where "m" in the formula represents that the cytokines are derived from mice. The protein molecule includes one polypeptide chain, wherein mIL12bIL12aIL2GMCSFDiaNHS76F8 represents that the interleukin IL12b, the interleukin IL12a, the interleukin IL2, the granulocyte macrophage colony stimulating factor (GMCSF) and the targeting moieties $NHS76V_H$, $F8V_L$, $F8V_H$, and $NHS76V_L$ are sequentially included in the polypeptide chain from the N-terminal to the C-terminal; and the targeting moieties in the order of NHS76V$_H$, F8V$_L$, F8V$_H$, and NHS76V$_L$ may be represented by DiaNHS76F8.

It should be noted that the structure of the protein molecule mIL12bIL12aIL2GMCSFDiaF8 (with the structure as shown in FIG. 15) is similar to the structure of the protein molecule mIL12bIL12aIL2GMCSFDiaNHS76F8, with a difference only in the targeting moieties. Therefore, the specific structure of the protein molecule mIL12bIL12aIL2GMCSFDiaF8 will not be repeated here in detail any more.

For example, FIG. 16 shows the structure of the protein molecule hIL12bIL12aDiaL19IL2GMCSF, where "h" in the formula represents that the cytokines are derived from human. The protein molecule includes one polypeptide chain, wherein hIL12bIL12aDiaL19IL2GMCSF represents that the interleukin IL12b, the interleukin IL12a, the targeting moieties L19V$_H$, L19V$_L$, L19V$_H$, and L19V$_L$, the interleukin IL2, and the granulocyte macrophage colony stimulating factor (GMCSF) are sequentially included in the polypeptide chain from the N-terminal to the C-terminal; and the targeting moieties in the order of L19V$_H$, L19V$_L$, L19V$_H$, and L19V$_L$ may be represented by DiaL19.

It should be noted that the structure of the protein molecule hIL12bIL12aDiaNHS76IL2GMCSF (with the structure as shown in FIG. 17) is similar to the structure of the protein molecule hIL12bIL12aDiaL19IL2GMCSF, with a difference only in the targeting moieties. Therefore, the specific structure of the protein molecule hIL12bIL12aDiaNHS76IL2GMCSF will not be repeated here in detail any more.

For example, FIG. 18 shows the structure of the protein molecule hIL12bIL12aDiaNHS76F8IL2GMCSF, where "h" in the formula represents that the cytokines are derived from human. The protein molecule includes one polypeptide chain, wherein hIL12bIL12aDiaNHS76F8IL2GMCSF represents that the interleukin IL12b, the interleukin IL12a, the targeting moieties NHS76V$_H$, F8V$_L$, F8V$_H$, and NHS76V$_L$, the interleukin IL2, and the granulocyte macrophage colony stimulating factor (GMCSF) are sequentially included in the polypeptide chain from the N-terminal to the C-terminal; and the targeting moieties in the order of NHS76V$_H$, F8V$_L$, F8V$_H$, and NHS76V$_L$ may be represented by DiaNHS76F8.

For example, FIG. 19 shows the structure of the protein molecule hIL12bIL12aIL2DiaNHS76F8GMCSF, where "h" in the formula represents that the cytokines are derived from human. The protein molecule includes one polypeptide chain, wherein hIL12bIL12aIL2DiaNHS76F8GMCSF represents that the interleukin IL12b, the interleukin IL12a, the interleukin IL2, the targeting moieties NHS76V$_H$, F8V$_L$, F8V$_H$, and NHS76V$_L$, and the granulocyte macrophage colony stimulating factor (GMCSF) are sequentially included in the polypeptide chain from the N-terminal to the C-terminal; and the targeting moieties in the order of NHS76V$_H$, F8V$_L$, F8V$_H$, and NHS76V$_L$ may be represented by DiaNHS76F8.

It should be noted that the structure of the protein molecule hIL12bIL12aIL2DiaF8GMCSF (with the structure as shown in FIG. 20) is similar to the structure of the protein molecule hIL12bIL12aIL2DiaNHS76F8GMCSF, with a difference only in the targeting moieties. Therefore, the specific structure of the protein molecule hIL12bIL12aIL2DiaF8GMCSF will not be repeated here in detail any more.

Example 4 Effect of Induced Expression of mIL12bIL12aDiaL19IL2GMCSF on Tumor Growth 4.1 Construction of Regulatable Expression Vector mIL12bIL12aDiaL19IL2GMCSF A gene coding sequence of mIL12bIL12aDiaL19IL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aDiaL19IL2GMCSF plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aDiaL19IL2GMCSF gene fragments were recovered for later use.

The amino acid sequence of the protein molecule mIL12bIL12aDiaL19IL2GMCSF is as set forth in SEQ ID NO. 49, and the nucleotide sequence encoding the mIL12bIL12aDiaL19IL2GMCSF is as set forth in SEQ ID NO. 90.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 µl, and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aDiaL19IL2GMCSF, with a linking system including: 2 µl of pLentis-PTRE-MCS-PGK-PURO, 2 µl of mIL12bIL12aDiaL19IL2GMCSF, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aDiaL19IL2GMCSF-PGK-PURO was successfully constructed.

4.2 Preparation of Cells Capable of Regulating and Expressing mIL12bIL12aDiaL19IL2GMCSF A virus of an mIL12bIL12aDiaL19IL2GMCSF expression vector was prepared with a method the same as that for preparing the virus of the first expression vector, to obtain a virus of a second expression vector pLentis-PTRE-mIL12bIL12aDiaL19IL2GMCSF-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aDiaL19IL2GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the m IL12bIL12aDiaL19IL2GMCSF, which were named as B16(rtTA)-mIL12bIL12aDiaL19IL-2GMCSF.

4.3 Effect of Induced Expression of mIL12bIL12aDiaL19IL2GMCSF on Tumor Growth

Figure 21:
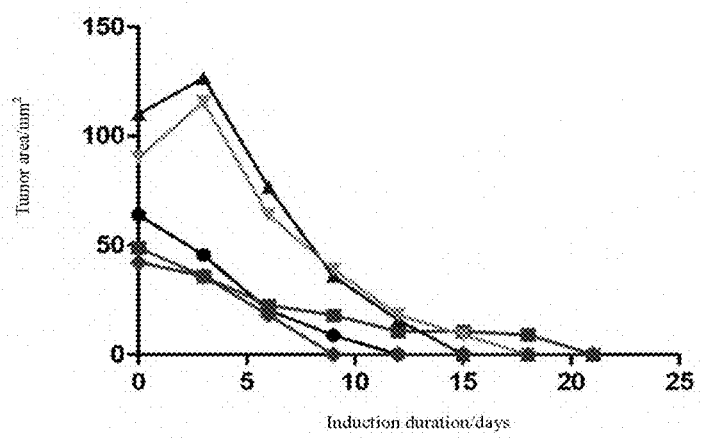
FIG. 21 shows the tumor regression in mice induced by a protein molecule mIL12bIL12aDiaL19IL2GMCSF.

The cells B16(rtTA)-mIL12bIL12aDiaL19IL2GMCSF in a logarithmic growth phase were digested, diluted with HBSS to $2\times10^6$ cells/ml, and injected into the right backs of a total of 10 C57BL/6 female mice being 8-10 weeks old at 500/mouse by using a 1 ml syringe. After tumors grew, the mice were fed with water containing 2 g/L doxycycline, and the tumor growth and tumor clearance rate in the mice were recorded, with the number of tumor-cleared mice/the total number of mice=9/10. As shown in FIG. 21, mIL12bscF8-IL2IL12aGMCSF can induce tumor regression in some mice.

Example 5 Effect of Induced Expression of mIL12bIL12aDiaF8IL2GMCSF on Tumor Growth 5.1 Construction of regulatable expression vector mImIL12bIL12aDiaF8IL2GMCSF A gene coding sequence of mIL12bIL12aDiaF8IL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aDiaF8IL2GMCSF plasmid, 4 µl of enzyme digestion buffer, 1 µl of BamHI and 1 µl of XhoI were added with water to a total volume of 400, and let stand at 37° C. for 12 hours. An EP tube was taken out and added with 4.4 µl of 10× loading buffer; electrophoresis was performed by using 1% agarose gel; and after the electrophoresis, mIL12bIL12aDiaF8IL2GMCSF gene fragments were recovered for later use.

The amino acid sequence of the protein molecule mIL12bIL12aDiaF8IL2GMCSF is as set forth in SEQ ID NO. 50, and the nucleotide sequence encoding the mIL12bIL12aDiaF8IL2GMCSF is as set forth in SEQ ID NO. 91.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aDiaF8IL2GMCSF, with a linking system including: 2 µl of pLentis-PTRE-MCS-PGK-PURO, 2 µl of mIL12bIL12aDiaF8IL2GMCSF, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aDiaF8IL2GMCSF-PGK-PURO was successfully constructed.

5.2 Preparation of Cells Capable of Regulating and Expressing mIL12bIL12aDiaF8IL2GMCSF A virus of an mIL12bIL12aDiaF8IL2GMCSF expression vector was prepared with a method the same as that for preparing the virus of the first expression vector, to obtain a virus of a second expression vector pLentis-PTRE-mIL12bIL12aDiaF8IL2GMCSF-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aDiaF8IL2GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aDiaF8IL2GMCSF, which were named as B16(rtTA)-mIL12bIL12aDiaF8IL2GMCSF.

5.3 Effect of Induced Expression of mIL12bIL12aDiaF8IL2GMCSF on Tumor Growth

Figure 22:
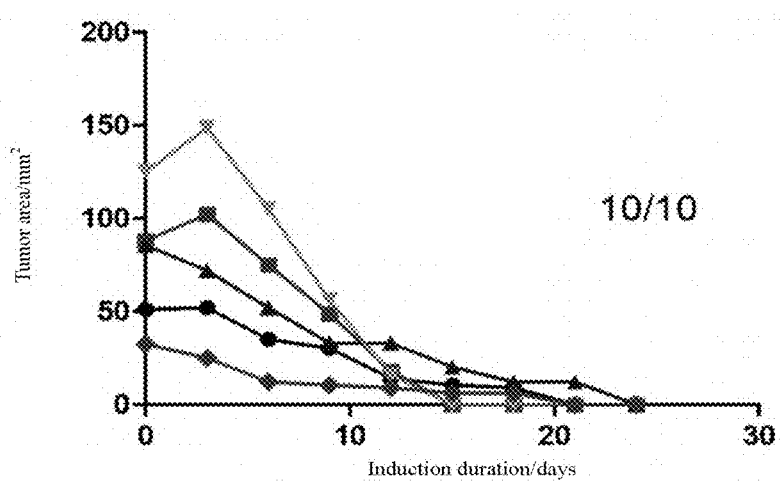
FIG. 22 shows the tumor regression in mice induced by a protein molecule mIL12IL12aDiaF8IL2GMCSF.

The cells B16(rtTA)-mIL12bIL12aDiaF8112GMCSF in a logarithmic growth phase were digested, diluted with HBSS to $2\times10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the tumor growth and tumor clearance rate in the mice were recorded, with the number of tumor-cleared mice/the total number of mice=10/10. As shown in FIG. 22, mIL12bIL12aDiaF8IL2GMCSF can induce tumor regression in some mice.

Example 6 Effect of Induced Expression of mIL12bIL12aDiaNHS76IL2GMCSF on Tumor Growth 6.1 Construction of Regulatable Expression Vector mIL12bIL12aDiaNHS76IL2GMCSF A gene coding sequence of mIL12bIL12aDiaNHS76IL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aDiaNHS76IL2GMCSF plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aDiaNHS76IL2GMCSF gene fragments were recovered for later use.

The amino acid sequence of the protein molecule mIL12bIL12aDiaNHS76IL2GMCSF is as set forth in SEQ ID NO. 51, and the nucleotide sequence encoding the mIL12bIL12aDiaNHS76IL2GMCSF is as set forth in SEQ ID NO. 92.

Enzyme digestion was performed on a regulatable expression vector pLentis-PTRE-MCS-PGK-PURO, with an enzyme digestion system as follows: 2 μg of pLentis-PTRE-MCS-PGK-PURO vector plasmid, 3 μl of enzyme digestion buffer, 1 μl of BamHI and 1 μl of XhoI were added with water to a total volume of 30 μl, and let stand at 37° C. for 12 hours. The EP tube was taken out and added with 3.3 μl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aDiaNHS76IL2GMCSF, with a linking system including: 2 μl of pLentis-PTRE-MCS-PGK-PURO, 2 μl of mIL12bIL12aDiaNHS76IL2GMCSF, 1 μl of ligase buffer, 0.5 μl of T4DNA ligase, and 4.5 μl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aDiaNHS76IL2GMCSF-PGK-PURO was successfully constructed.

6.2 Preparation of Cells Capable of Regulating and Expressing mIL12bIL12aDiaNHS76IL2GMCSF A virus of an mIL12bIL12aDiaNHS76IL2GMCSF expression vector was prepared with a method the same as that for preparing the virus of the first expression vector, to obtain a virus of a second expression vector pLentis-PTRE-mIL12bIL12aDiaNHS76IL2GMCSF-PGK-PURO.

The cultured tumor cells B16 (rtTA) were digested, inoculated into a 6-well plate at $10^5$ cells/well, with a culture volume of 1 ml. After 24 hours, 10 μl of the virus of the second regulatable expression vector pLentis-PTRE-mIL12bIL12aDiaNHS76IL2GMCSF-PGK-PURO was added.

After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 μg/ml. After the culturing was continued for three days, the survived cells were the cells capable of regulating and expressing the mIL12bIL12aDiaNHS76IL2GMCSF, which were named as B16(rtTA)-mIL12bIL12aDiaNHS76IL2GMCSF.

6.3 Effect of Induced Expression of mIL12bIL12aDiaNHS76IL2GMCSF on Tumor Growth

Figure 23:
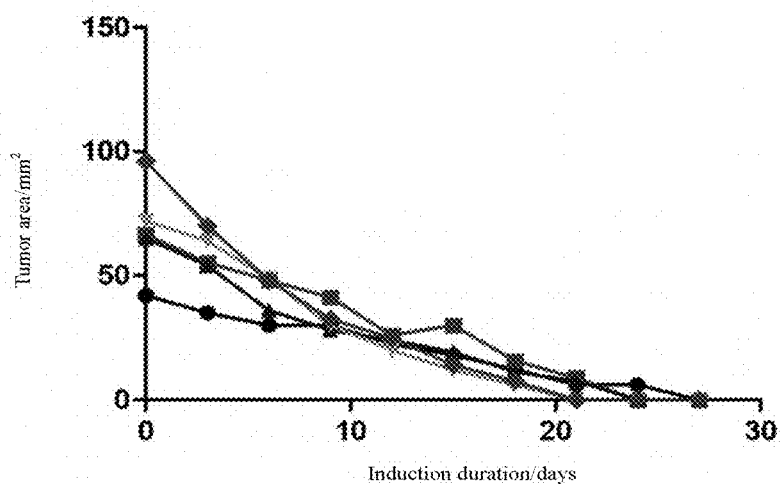
FIG. 23 shows the tumor regression in mice induced by a protein molecule mIL12IL12aDiaNHS76IL2GMCSF.

The cells B16(rtTA)-mIL12bIL12aDiaNHS76IL2GMCSF in a logarithmic growth phase were digested, diluted with HBSS to $2×10^6$ cells/ml, and injected into the right backs of a total of 10 C57BL/6 female mice being 8-10 weeks old at 50 μl/mouse by using a 1 ml syringe. After tumors grew, the mice were fed with water containing 2 g/L doxycycline, and the tumor growth and tumor clearance rate in the mice were recorded, with the number of tumor-cleared mice/the total number of mice=10/10. As shown in FIG. 23, mIL12bIL12aDiaNHS76IL2GMCSF can induce tumor regression in some mice.

Example 7 Effect of Induced Expression of mIL12bIL12aDiaNHS76F8IL2GMCSF on Tumor Growth 7.1 Construction of Regulatable Expression Vector mIL12bIL12aDiaNHS76F8IL2GMCSF A gene coding sequence of mIL12bIL12aDiaNHS76F8IL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 μg of mIL12bIL12aDiaNHS76F8IL2GMCSF plasmid, 4 μl of enzyme digestion buffer, 1 μl of BamHI and 1 μl of XhoI were added with water to a total volume of 40 μl, and let stand at 37° C. for 12 hours. An EP tube was taken out and added with 4.4 μl of 10× loading buffer; electrophoresis was performed by using 1% agarose gel; and after the electrophoresis, mIL12bIL12aDiaNHS76F8IL2GMCSF gene fragments were recovered for later use.

The amino acid sequence of the protein molecule mIL12bIL12aDiaNHS76F8IL2GMCSF is as set forth in SEQ ID NO. 52, and the nucleotide sequence encoding the mIL12bIL12aDiaNHS76F8IL2GMCSF is as set forth in SEQ ID NO. 93.

Enzyme digestion was performed on a regulatable expression vector pLentis-PTRE-MCS-PGK-PURO, with an enzyme digestion system as follows: 2 μg of pLentis-PTRE-MCS-PGK-PURO vector plasmid, 3 μl of enzyme digestion buffer, 1 μl of BamHI and 1 μl of XhoI were added with water to a total volume of 30 and let stand at 37° C. for 12 hours. The EP tube was taken out and added with 3.3 μl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aDiaNHS76F8IL2GMCSF, with a linking system including: 2 μl of pLentis-PTRE-MCS-PGK-PURO, 2 μl of IL12bIL12aDiaNHS76F8IL2GMCSF, 1 μl of ligase buffer, 0.5 μl of T4DNA ligase, and 4.5 μl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aDiaNHS76F8IL2GMCSF-PGK-PURO was successfully constructed.

7.2 Preparation of Cells Capable of Regulating and Expressing mIL12bIL12aDiaNHS76F8IL2GMCSF A virus of an mIL12bIL12aDiaNHS76F8IL2GMCSF expression vector was prepared with a method the same as that for preparing the virus of the first expression vector, to obtain a virus of a second expression vector pLentis-PTRE-mIL12bIL12aDiaNHS76F8IL2GMCSF-PGK-PURO.

The cultured tumor cells B16 (rtTA) were digested, inoculated into a 6-well plate at $10^5$ cells/well, with a culture volume of 1 ml. After 24 hours, 10 μl of the virus of the second regulatable expression vector pLentis-PTRE-mIL12bIL12aDiaNHS76F8IL2GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 μg/ml. After the culturing was continued for three days, the survived cells were the cells capable of regulating and expressing the mIL12bIL12aDiaNHS76F8IL2GMCSF, which were named as B16(rtTA)-mIL12bIL12aDiaNHS76F8IL2GMCSF.

Figure 24:
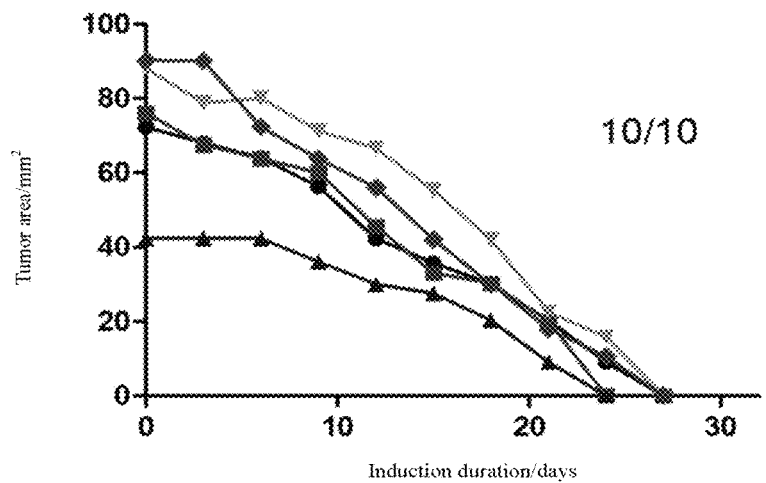
FIG. 24 shows the tumor regression in mice induced by a protein molecule mIL12IL12aDiaNHS76F8IL2GMCSF.

7.3 Effect of Induced Expression of mIL12bIL12aDiaNHS76F8IL2GMCSF on Tumor Growth The cells B16(rtTA)-mIL12bIL12aDiaNHS76F8IL2-GMCSF in a logarithmic growth phase were digested, diluted with HBSS to $2\times10^6$ cells/ml, and injected into the right backs of a total of 10 C57BL/6 female mice being 8-10 weeks old at SOW/mouse by using a 1 ml syringe. After tumors grew, the mice were fed with water containing 2 g/L doxycycline, and the tumor growth and tumor clearance rate in the mice were recorded, with the number of tumor-cleared mice/the total number of mice=10/10. As shown in FIG. 24, mIL12bIL12aDiaNHS76F8IL2GMCSF can induce tumor regression in some mice.

Example 8 Effect of Induced Expression of mIL12bIL12aDiaNHS76L19IL2GMCSF on Tumor Growth 8.1 Construction of Regulatable Expression Vector mIL12bIL12aDiaNHS76L19IL2GMCSF A gene coding sequence of mIL12bIL12aDiaNHS76L19IL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 μg of mIL12bIL12aDiaNHS76L19IL2GMCSF plasmid, 4 μl of enzyme digestion buffer, 1 μl of BamHI and 1 μl of XhoI were added with water to a total volume of 40 μl, and let stand at 37° C. for 12 hours. An EP tube was taken out and added with 4.4 μl of 10× loading buffer; electrophoresis was performed by using 1% agarose gel; and after the electrophoresis, mIL12bIL12aDiaNHS76L19IL2GMCSF gene fragments were recovered for later use.

The amino acid sequence of the protein molecule mIL12bIL12aDiaNHS76L19IL2GMCSF is as set forth in SEQ ID NO. 53, and the nucleotide sequence encoding the mIL12bIL12aDiaNHS76L19IL2GMCSF is as set forth in SEQ ID NO. 94.

Enzyme digestion was performed on a regulatable expression vector pLentis-PTRE-MCS-PGK-PURO, with an enzyme digestion system as follows: 2 μg of pLentis-PTRE-MCS-PGK-PURO vector plasmid, 3 μl of enzyme digestion buffer, 1 μl of BamHI and 1 μl of XhoI were added with water to a total volume of 30 and let stand at 37° C. for 12 hours. The EP tube was taken out and added with 3.3 μl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aDiaNHS76L19IL2GMCSF, with a linking system including: 2 μl of pLentis-PTRE-MCS-PGK-PURO, 2 μl of mIL12bIL12aDiaNHS76L19IL2GMCSF, 1 μl of ligase buffer, 0.5 μl of T4DNA ligase, and 4.5 μl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aDiaNHS76L19IL2GMCSF-PGK-PURO was successfully constructed.

8.2 Preparation of Cells Capable of Regulating and Expressing mIL12bIL12aDiaNHS76L19IL2GMCSF A virus of an mIL12bIL12aDiaNHS76L19IL2GMCSF expression vector was prepared with a method the same as that for preparing the virus of the first expression vector, to obtain a virus of a second expression vector pLentis-PTRE-mIL12bIL12aDiaNHS76L19IL2GMCSF-PGK-PURO.

The cultured tumor cells B16 (rtTA) were digested, inoculated into a 6-well plate at $10^5$ cells/well, with a culture volume of 1 ml. After 24 hours, 10 μl of the virus of the second regulatable expression vector pLentis-PTRE-mIL12bIL12aDiaNHS76L19IL2GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 μg/ml. After the culturing was continued for three days, the survived cells were the cells capable of regulating and expressing the mIL12bIL12aDiaNHS76L19IL2GMCSF, which were named as B16(rtTA)-mIL12bIL12aDiaNHS76L19IL2GMCSF.

Figure 25:
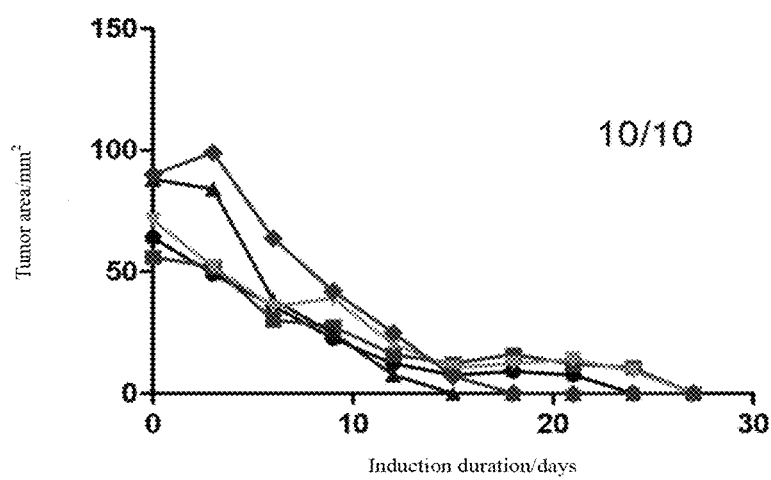
FIG. 25 shows the tumor regression in mice induced by a protein molecule mIL12IL12aDiaNHS76L19IL2GMCSF.

8.3 Effect of Induced Expression of mIL12bIL12aDiaNHS76L19IL2GMCSF on Tumor Growth The cells B16(rtTA)-mIL12bIL12aDiaNHS76L19IL2GMCSF in a logarithmic growth phase were digested, diluted with HBSS to $2\times10^6$ cells/ml, and injected into the right backs of a total of 10 C57BL/6 female mice being 8-10 weeks old at SOW/mouse by using a 1 ml syringe. After tumors grew, the mice were fed with water containing 2 g/L doxycycline, and the tumor growth and tumor clearance rate in the mice were recorded, with the number of tumor-cleared mice/the total number of mice=10/10. As shown in FIG. 25, mIL12bIL12aDiaNHS76L19IL2GMCSF can induce tumor regression in some mice.

Example 9 Effect of Induced Expression of mIL12bIL12aDiaF8NHS76IL2GMCSF on Tumor Growth 9.1 Construction of Regulatable Expression Vector mIL12bIL12aDiaF8NHS76IL2GMCSF A gene coding sequence of mIL12bIL12aDiaF8-NHS76IL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 μg of mIL12bIL12aDiaF8NHS76IL2GMCSF plasmid, 4 μl of enzyme digestion buffer, 1 μl of BamHI and 1 μl of XhoI were added with water to a total volume of 40 μl, and let stand at 37° C. for 12 hours. An EP tube was taken out and added with 4.4 μl of 10× loading buffer; electrophoresis was performed by using 1% agarose gel; and after the electrophoresis, mIL12bIL12aDiaF8NHS76IL2GMCSF gene fragments were recovered for later use.

The amino acid sequence of the protein molecule mIL12bIL12aDiaF8NHS76IL2GMCSF is as set forth in SEQ ID NO. 54, and the nucleotide sequence encoding the mIL12bIL12aDiaF8NHS76IL2GMCSF is as set forth in SEQ ID NO. 95.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 µl, and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aDiaF8NHS76IL2GMCSF, with a linking system including: 2 µl of pLentis-PTRE-MCS-PGK-PURO, 2 µl of mIL12bIL12aDiaF8NHS76IL2GMCSF, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aDiaF8NHS76IL2GMCSF-PGK-PURO was successfully constructed.

9.2 Preparation of Cells Capable of Regulating and Expressing mIL12bIL12aDiaF8NHS76IL2GMCSF A virus of an mIL12bIL12aDiaF8NHS76IL2GMCSF expression vector was prepared with a method the same as that for preparing the virus of the first expression vector, to obtain a virus of a second expression vector pLentis-PTRE-mIL12bIL12aDiaF8NHS76IL2GMCSF-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aDiaF8NHS76IL2GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aDiaF-8NHS76IL2GMCSF, which were named as B16(rtTA)-mIL12bIL12aDiaF8NHS76IL2GMCSF.

Figure 26:
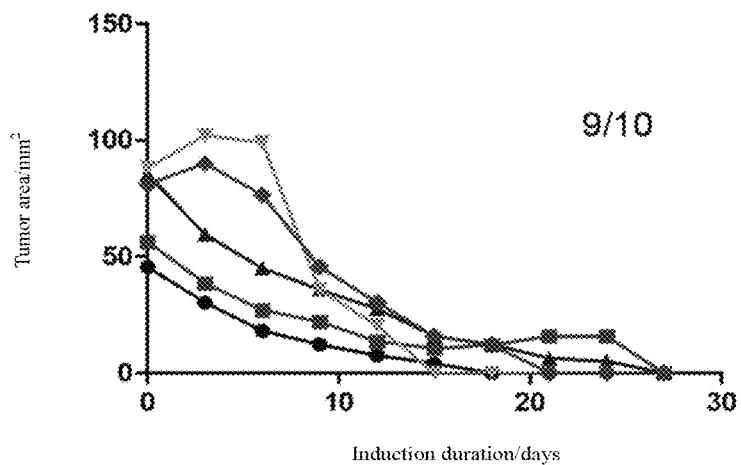
FIG. 26 shows the tumor regression in mice induced by a protein molecule mIL12IL12aDiaF8NHS76IL2GMCSF.

9.3 Effect of Induced Expression of mIL12bIL12aDiaF8-NHS76IL2GMCSF on Tumor Growth The cells B16(rtTA)-mIL12bIL12aDiaF8NHS76IL2-GMCSF in a logarithmic growth phase were digested, diluted with HBSS to $2\times10^6$ cells/ml, and injected into the right backs of a total of 10 C57BL/6 female mice being 8-10 weeks old at SOW/mouse by using a 1 ml syringe. After tumors grew, the mice were fed with water containing 2 g/L doxycycline, and the tumor growth and tumor clearance rate in the mice were recorded, with the number of tumor-cleared mice/the total number of mice=9/10. As shown in FIG. 26, mIL12bIL12aDiaF8NHS76IL2GMCSF can induce tumor regression in some mice.

Example 10 Effect of Induced Expression of mIL12bIL12aDiaF8L19IL2GMCSF on Tumor Growth 10.1 Construction of Regulatable Expression Vector mIL12bIL12aDiaF8L19IL2GMCSF A gene coding sequence of mIL12bIL12aDiaF8L-19IL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aDiaF8L19IL2GMCSF plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aDiaF8L19IL2GMCSF gene fragments were recovered for later use.

The amino acid sequence of the protein molecule mIL12bIL12aDiaF8L19IL2GMCSF is as set forth in SEQ ID NO. 55, and the nucleotide sequence encoding the mIL12bIL12aDiaF8L19IL2GMCSF is as set forth in SEQ ID NO. 96.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 µl, and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aDiaF8L19IL2GMCSF, with a linking system including: 2 µl of pLentis-PTRE-MCS-PGK-PURO, 2 µl of mIL12bIL12aDiaF8L19IL2GMCSF, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aDiaF8L19IL2GMCSF-PGK-PURO was successfully constructed.

10.2 Preparation of Cells Capable of Regulating and Expressing mIL12bIL12aDiaF8L19IL2GMCSF A virus of an mIL12bIL12aDiaF8L19IL2GMCSF expression vector was prepared with a method the same as that for preparing the virus of the first expression vector, to obtain a virus of a second expression vector pLentis-PTRE-mIL12bIL12aDiaF8L19IL2GMCSF-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aDiaF8L19IL2GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aDiaF8-L19IL2GMCSF, which were named as B16(rtTA)-mIL12bIL12aDiaF8L19IL2GMCSF.

Figure 27:
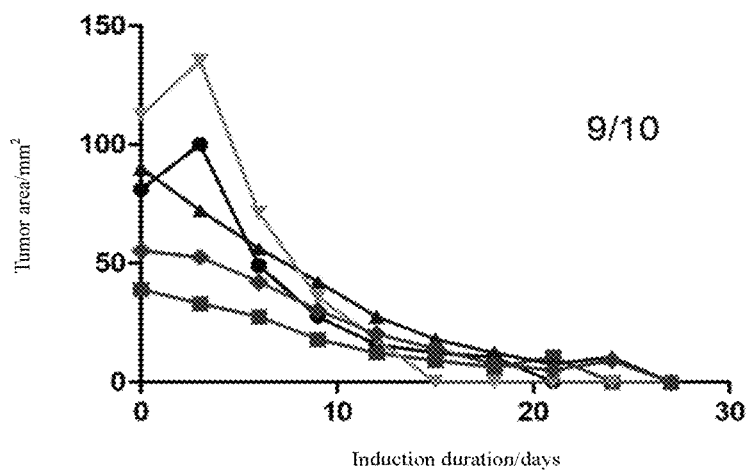
FIG. 27 shows the tumor regression in mice induced by a protein molecule mIL12IL12aDiaF8L19IL2GMCSF.

10.3 Effect of Induced Expression of mIL12bIL12aDiaF8L19IL2GMCSF on Tumor Growth The cells B16(rtTA)-mIL12bIL12aDiaF8L19IL2GMCSF in a logarithmic growth phase were digested, diluted with HBSS to $2\times10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the tumor growth and tumor clearance rate in the mice were recorded, with the number of tumor-cleared mice/the total number of mice=9/10. As shown in FIG. 27, mIL12bIL12aDiaF8L19IL2GMCSF can induce tumor regression in some mice.

Example 11 Effect of Induced Expression of mIL12bIL12aDiaL19NHS76IL2GMCSF on Tumor Growth 11.1 Construction of Regulatable Expression Vector mIL12bIL12aDiaL19NHS76IL2GMCSF A gene coding sequence of mIL12bIL12aDiaL19NHS76IL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aDiaL19NHS76IL2GMCSF plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12IL12aDiaL19NHS76IL2GMCSF gene fragments were recovered for later use.

The amino acid sequence of the protein molecule mIL12bIL12aDiaL19NHS76IL2GMCSF is as set forth in SEQ ID NO. 56, and the nucleotide sequence encoding the mIL12IL12aDiaL19NHS76IL2GMCSF is as set forth in SEQ ID NO. 97.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aDiaL19NHS76IL2GMCSF, with a linking system including: 2 µl of pLentis-PTRE-MCS-PGK-PURO, 2 µl of mIL12IL12aDiaL19NHS76IL2GMCSF, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aDiaL19NHS76IL2GMCSF-PGK-PURO was successfully constructed.

11.2 Preparation of Cells Capable of Regulating and Expressing mIL12bIL12aDiaL19NHS76IL2GMCSF A virus of an mIL12bIL12aDiaL19NHS76IL2GMCSF expression vector was prepared with a method the same as that for preparing the virus of the first expression vector, to obtain a virus of a second expression vector pLentis-PTRE-mIL12bIL12aDiaL19NHS76IL2GMCSF-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aDiaL19NHS76IL2GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aDiaL19NHS76IL2GMCSF, which were named as B16(rtTA)-mIL12bIL12aDiaL19NHS76IL2GMCSF.

Figure 28:
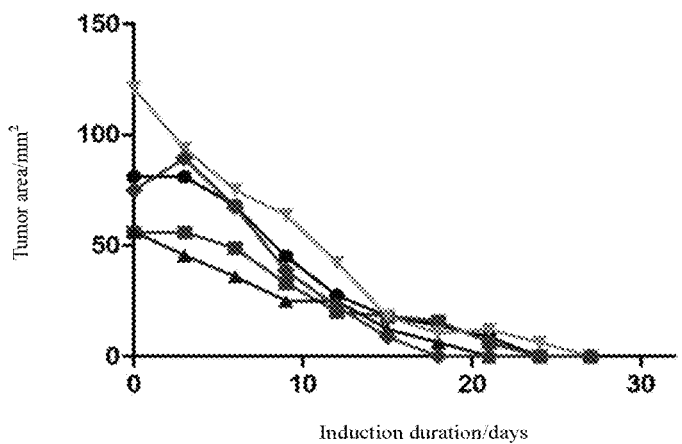
FIG. 28 shows the tumor regression in mice induced by a protein molecule mIL12IL12aDiaL19NHS76IL2GMCSF.

11.3 Effect of Induced Expression of mIL12bIL12aDiaL19NHS76IL2GMCSF on Tumor Growth The cells B16(rtTA)-mIL12bIL12aDiaL19NHS76IL2GMCSF in a logarithmic growth phase were digested, diluted with HBSS to $2\times10^6$ cells/ml, and injected into the right backs of a total of 10 C57BL/6 female mice being 8-10 weeks old at SOW/mouse by using a 1 ml syringe. After tumors grew, the mice were fed with water containing 2 g/L doxycycline, and the tumor growth and tumor clearance rate in the mice were recorded, with the number of tumor-cleared mice/the total number of mice=8/10. As shown in FIG. 28, mIL12bIL12aDiaL19NHS76IL2GMCSF can induce tumor regression in some mice.

Example 12 Effect of Induced Expression of mIL12bIL12aDiaL19F8IL2GMCSF on Tumor Growth 12.1 Construction of Regulatable Expression Vector mIL12bIL12aDiaL19F8IL2GMCSF A gene coding sequence of mIL12bIL12aDiaL-19F8IL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aDiaL19F8IL2GMCSF plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aDiaL19F8IL2GMCSF gene fragments were recovered for later use.

The amino acid sequence of the protein molecule mIL12bIL12aDiaL19F8IL2GMCSF is as set forth in SEQ ID NO. 57, and the nucleotide sequence encoding the mIL12bIL12aDiaL19F8IL2GMCSF is as set forth in SEQ ID NO. 98.

Enzyme digestion was performed on a regulatable expression vector pLentis-PTRE-MCS-PGK-PURO, with an enzyme digestion system as follows: 2 μg of pLentis-PTRE-MCS-PGK-PURO vector plasmid, 3 μl of enzyme digestion buffer, 1 μl of BamHI and 1 μl of XhoI were added with water to a total volume of 30 and let stand at 37° C. for 12 hours. The EP tube was taken out and added with 3.3 μl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aDiaL19F8IL2GMCSF, with a linking system including: 2 μl of pLentis-PTRE-MCS-PGK-PURO, 2 μl of mIL12bIL12aDiaL19F8IL2GMCSF, 1 μl of ligase buffer, 0.5 μl of T4DNA ligase, and 4.5 μl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aDiaL19F8IL2GMCSF-PGK-PURO was successfully constructed.

12.2 Preparation of Cells Capable of Regulating and Expressing mIL12bIL12aDiaL19F8IL2GMCSF A virus of an mIL12bIL12aDiaL19F8IL2GMCSF expression vector was prepared with a method the same as that for preparing the virus of the first expression vector, to obtain a virus of a second expression vector pLentis-PTRE-mIL12bIL12aDiaL19F8IL2GMCSF-PGK-PURO The cultured tumor cells B16 (rtTA) were digested, inoculated into a 6-well plate at $10^5$ cells/well, with a culture volume of 1 ml. After 24 hours, 10 μl of the virus of the second regulatable expression vector pLentis-PTRE-mIL12bIL12aDiaL19F8IL2GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 μg/ml. After the culturing was continued for three days, the survived cells were the cells capable of regulating and expressing the mIL12bIL12aDiaL19F8IL2GMCSF, which were named as B16(rtTA)-mIL12bIL12aDiaL19F8IL2GMCSF.

Figure 29:
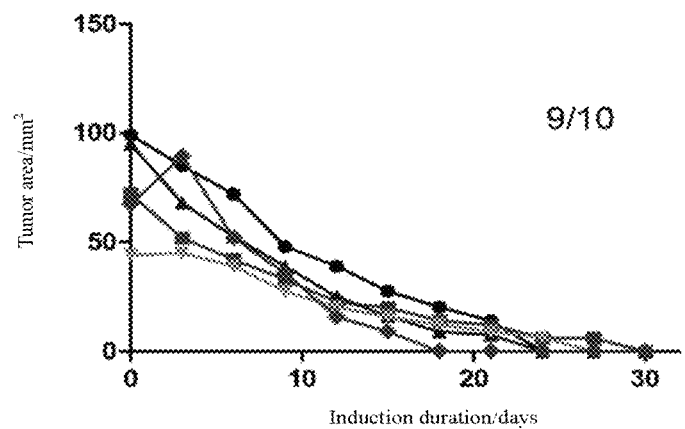
FIG. 29 shows the tumor regression in mice induced by a protein molecule mIL12IL12aDiaL19F8IL2GMCSF.

12.3 Effect of Induced Expression of mIL12bIL12aDiaL19F8IL2GMCSF on Tumor Growth The cells B16(rtTA)-mIL12bIL12aDiaL19F8IL2GMCSF in a logarithmic growth phase were digested, diluted with HBSS to $2\times10^6$ cells/ml, and injected into the right backs of a total of 10 C57BL/6 female mice being 8-10 weeks old at 50 μL/mouse by using a 1 ml syringe. After tumors grew, the mice were fed with water containing 2 g/L doxycycline, and the tumor growth and tumor clearance rate in the mice were recorded, with the number of tumor-cleared mice/the total number of mice=9/10. As shown in FIG. 29, mIL12bIL12aDiaL19F8IL2GMCSF can induce tumor regression in some mice.

Example 13 Effect of Induced Expression of mIL12bIL12aIL2DiaNHS76F8GMCSF on Tumor Growth 13.1 Construction of Regulatable Expression Vector mIL12bIL12aIL2DiaNHS76F8GMCSF A gene coding sequence of mIL12bIL12aDiaL19F8IL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 μg of mIL12bIL12aIL2DiaNHS76F8GMCSF plasmid, 4 μl of enzyme digestion buffer, 1 μl of BamHI and 1 μl of XhoI were added with water to a total volume of 40 μl, and let stand at 37° C. for 12 hours. An EP tube was taken out and added with 4.4 μl of 10× loading buffer; electrophoresis was performed by using 1% agarose gel; and after the electrophoresis, mIL12bIL12aIL2DiaNHS76F8GMCSF gene fragments were recovered for later use.

The amino acid sequence of the protein molecule mIL12bIL12aIL2DiaNHS76F8GMCSF is as set forth in SEQ ID NO. 58, and the nucleotide sequence encoding the mIL12bIL12aIL2DiaNHS76F8GMCSF is as set forth in SEQ ID NO. 99.

Enzyme digestion was performed on a regulatable expression vector pLentis-PTRE-MCS-PGK-PURO, with an enzyme digestion system as follows: 2 μg of pLentis-PTRE-MCS-PGK-PURO vector plasmid, 3 μl of enzyme digestion buffer, 1 μl of BamHI and 1 μl of XhoI were added with water to a total volume of 30 and let stand at 37° C. for 12 hours. The EP tube was taken out and added with 3.3 μl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL2DiaNHS76F8GMCSF, with a linking system including: 2 μl of pLentis-PTRE-MCS-PGK-PURO, 2 μl of mIL12bIL12aIL2DiaNHS76F8GMCSF, 1 μl of ligase buffer, 0.5 μl of T4DNA ligase, and 4.5 μl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL2DiaNHS76F8GMCSF-PGK-PURO was successfully constructed.

13.2 Preparation of Cells Capable of Regulating and Expressing mIL12bIL12aIL2DiaNHS76F8GMCSF A virus of an mIL12bIL12aIL2DiaNHS76F8GMCSF expression vector was prepared with a method the same as that for preparing the virus of the first expression vector, to obtain a virus of a second expression vector pLentis-PTRE-mIL12bIL12aIL2DiaNHS76F8GMCSF-PGK-PURO The cultured tumor cells B16 (rtTA) were digested, inoculated into a 6-well plate at $10^5$ cells/well, with a culture volume of 1 ml. After 24 hours, 10 μl of the virus of the second regulatable expression vector pLentis-PTRE-mIL12bIL12aIL2DiaNHS76F8GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 μg/ml. After the culturing was continued for three days, the survived cells were the cells capable of regulating and expressing the mIL12bIL12aIL2-DiaNHS76F8GMCSF, which were named as B16(rtTA)-mIL12bIL12aIL2DiaNHS76F8GMCSF.

Figure 30:
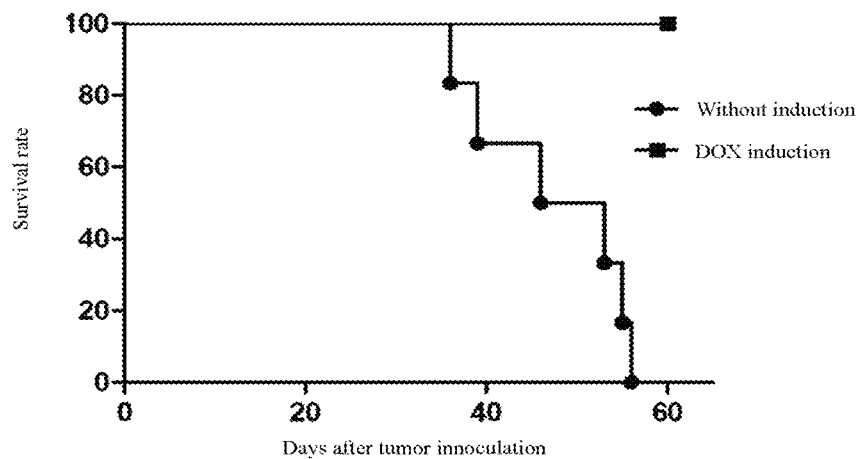
FIG. 30 shows the effect of a protein molecule mIL12bIL12aIL2DiaNHS76F8GMCSF on the survival rate of mice.

13.3 Effect of Induced Expression of mIL12bIL12aIL-2DiaNHS76F8GMCSF on Tumor Growth The cells B16(rtTA)-mIL12bIL12aIL2DiaNHS76-F8GMCSF in a logarithmic growth phase were digested, diluted with HBSS to $2\times10^6$ cells/ml, and injected into the right backs of a total of 10 C57BL/6 female mice being 8-10 weeks old at 50 μl/mouse by using a 1 ml syringe. After tumors grew, the mice were fed with water containing 2 g/L doxycycline, and the survival of the mice was recorded. As shown in FIG. 30, the induced expression of mIL12bIL12aIL2DiaNHS76F8GMCSF significantly improves the survival rate for the mice.

Example 14 Effect of Induced Expression of mIL12bIL12aIL2DiaF8GMCSF on Tumor Growth 14.1 Construction of Regulatable Expression Vector mIL12bIL12aIL2DiaF8GMCSF A gene coding sequence of mIL12bIL12aIL2Dia-F8GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 μg of mIL12bIL12aIL2DiaNHS76F8GMCSF plasmid, 4 μl of enzyme digestion buffer, 1 μl of BamHI and 1 μl of XhoI were added with water to a total volume of 40 μl, and let stand at 37° C. for 12 hours. An EP tube was taken out and added with 4.4 μl of 10× loading buffer; electrophoresis was performed by using 1% agarose gel; and after the electrophoresis, mIL12bIL12aIL2DiaF8GMCSF gene fragments were recovered for later use.

The amino acid sequence of the protein molecule mIL12bIL12aIL2DiaF8GMCSF is as set forth in SEQ ID NO. 59, and the nucleotide sequence encoding the mIL12bIL12aIL2DiaF8GMCSF is as set forth in SEQ ID NO. 100.

Enzyme digestion was performed on a regulatable expression vector pLentis-PTRE-MCS-PGK-PURO, with an enzyme digestion system as follows: 2 μg of pLentis-PTRE-MCS-PGK-PURO vector plasmid, 3 μl of enzyme digestion buffer, 1 μl of BamHI and 1 μl of XhoI were added with water to a total volume of 30 μl, and let stand at 37° C. for 12 hours. The EP tube was taken out and added with 3.3 μl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL2DiaF8GMCSF, with a linking system including: 2 μl of pLentis-PTRE-MCS-PGK-PURO, 2 μl of mIL12bIL12aIL2DiaF8GMCSF, 1 μl of ligase buffer, 0.5 μl of T4DNA ligase, and 4.5 μl of water. The mixture was left at room temperature for linkage for 4 hours. Then, the linking system was subjected to competent Escherichia coli transformation. On the second day, colonies were picked from the transformed plate, placed in an LB medium, and cultured overnight in a shaker at 37° C.

Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL2DiaF8GMCSF-PGK-PURO was successfully constructed.

14.2 Preparation of Cells Capable of Regulating and Expressing mIL12bIL12aIL2DiaF8GMCSF A virus of an mIL12bIL12aIL2DiaF8GMCSF expression vector was prepared with a method the same as that for preparing the virus of the first expression vector, to obtain a virus of a second expression vector pLentis-PTRE-mIL12bIL12aIL2DiaF8GMCSF-PGK-PURO.

The cultured tumor cells B16 (rtTA) were digested, inoculated into a 6-well plate at $10^5$ cells/well, with a culture volume of 1 ml. After 24 hours, 10 μl of the virus of the second regulatable expression vector pLentis-PTRE-mIL12bIL12aIL2DiaF8GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 μg/ml. After the culturing was continued for three days, the survived cells were the cells capable of regulating and expressing the mIL12bIL12aIL2DiaF8GMCSF, which were named as B16(rtTA)-mIL12bIL12aIL2DiaF8 GMCSF.

14.3 Effect of Induced Expression of mIL12bIL12aIL2DiaF8GMCSF on Tumor Growth

Figure 31:
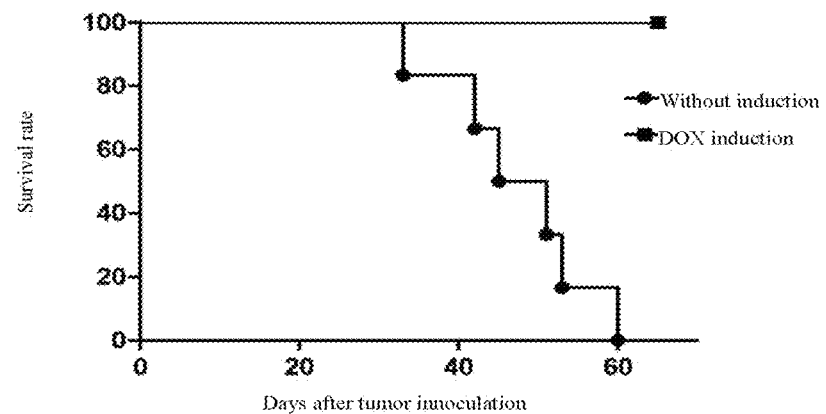
FIG. 31 shows the effect of a protein molecule mIL12bIL12aIL2DiaF8GMCSF on the survival rate of mice.

The cells B16(rtTA)-mIL12bIL12aIL2DiaF8GMCSF in a logarithmic growth phase were digested, diluted with HBSS to $2\times10^6$ cells/ml, and injected into the right backs of a total of 10 C57BL/6 female mice being 8-10 weeks old at 50 μl/mouse by using a 1 ml syringe. After tumors grew, the mice were fed with water containing 2 g/L doxycycline, and the survival of the mice was recorded. As shown in FIG. 31, the induced expression of mIL12bIL12aIL2DiaF8GMCSF significantly improves the survival rate for the mice.

Example 15 Effect of Induced Expression of mIL12bIL12aIL2GMCSFDiaNHS76F8 on Tumor Growth 15.1 Construction of Regulatable Expression Vector mIL12bIL12aIL2GMCSFDiaNHS76F8

A gene coding sequence of mIL12bIL12aIL2GMCS-FDiaNHS76F8 with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 μg of mIL12bIL12aIL2GMCSFDiaNHS76F8 plasmid, 4 μl of enzyme digestion buffer, 1 μl of BamHI and 1 μl of XhoI were added with water to a total volume of 40 μl, and let stand at 37° C. for 12 hours. An EP tube was taken out and added with 4.4 μl of 10× loading buffer; electrophoresis was performed by using 1% agarose gel; and after the electrophoresis, mIL12bIL12aIL2GMCSFDiaNHS76F8 gene fragments were recovered for later use.

The amino acid sequence of the protein molecule mIL12bIL12aIL2GMCSFDiaNHS76F8 is as set forth in SEQ ID NO. 60, and the nucleotide sequence encoding the mIL12bIL12aIL2GMCSFDiaNHS76F8 is as set forth in SEQ ID NO. 101.

Enzyme digestion was performed on a regulatable expression vector pLentis-PTRE-MCS-PGK-PURO, with an enzyme digestion system as follows: 2 μg of pLentis-PTRE-MCS-PGK-PURO vector plasmid, 3 μl of enzyme digestion buffer, 1 μl of BamHI and 1 μl of XhoI were added with water to a total volume of 30 μl, and let stand at 37° C. for 12 hours. The EP tube was taken out and added with 3.3 μl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL2GMCSFDiaNHS76F8, with a linking system including: 2 μl of pLentis-PTRE-MCS-PGK-PURO, 2 μl of mIL12bIL12aIL2GMCSFDiaNHS76F8, 1 μl of ligase buffer, 0.5 μl of T4DNA ligase, and 4.5 μl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL2GMCSFDiaNHS76F8-PGK-PURO was successfully constructed.

15.2 Preparation of Cells Capable of Regulating and Expressing mIL12bIL12aIL2GMCSFDiaNHS76F8

A virus of an mIL12bIL12aIL2GMCSFDiaNHS76F8 expression vector was prepared with a method the same as that for preparing the virus of the first expression vector, to obtain a virus of a second expression vector pLentis-PTRE-mIL12bIL12aIL2GMCSFDiaNHS76F8-PGK-PURO The cultured tumor cells B16 (rtTA) were digested, inoculated into a 6-well plate at $10^5$ cells/well, with a culture volume of 1 ml. After 24 hours, 10 μl of the virus of the second regulatable expression vector pLentis-PTRE-mIL12bIL12aIL2GMCSFDiaNHS76F8-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 μg/ml. After the culturing was continued for three days, the survived cells were the cells capable of regulating and expressing the mIL12bIL12aIL2-GMCSFDiaNHS76F8, which were named as B16(rtTA)-mIL12bIL12aIL2GMCSFDiaNHS76F8.

Figure 32:
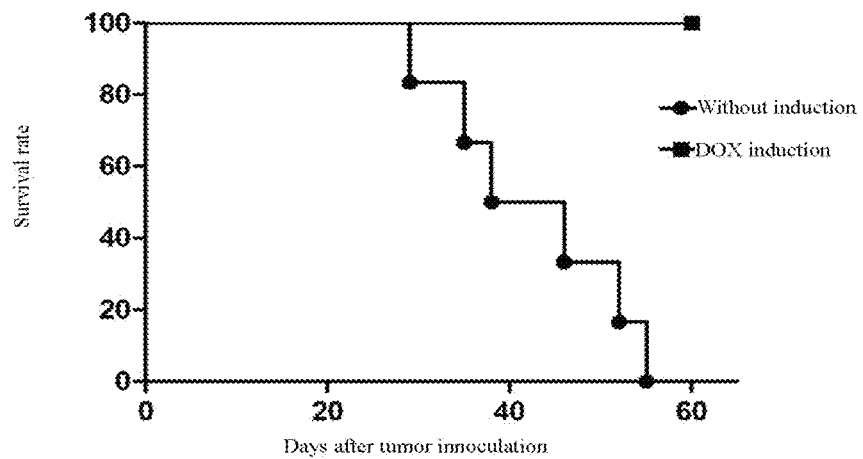
FIG. 32 shows the effect of a protein molecule mIL12bIL12aIL2GMCSFDiaNHS76F8 on the survival rate of mice.

15.3 Effect of Induced Expression of mIL12bIL12aIL2GMCSFDiaNHS76F8 on Tumor Growth The cells B16(rtTA)-mIL12bIL12aIL2GMCSFDiaNHS76F8 in a logarithmic growth phase were digested, diluted with HBSS to $2\times10^6$ cells/ml, and injected into the right backs of a total of 10 C57BL/6 female mice being 8-10 weeks old at 50 μl/mouse by using a 1 ml syringe. After tumors grew, the mice were fed with water containing 2 g/L doxycycline, and the survival of the mice was recorded. As shown in FIG. 32, the induced expression of mIL12bIL12aIL2GMCSFDiaNHS76F8 significantly improves the survival rate for the mice.

Example 16 Effect of Induced Expression of mIL12bIL12aIL2DiaNHS76F8GMCSF-Thr on Tumor Growth 16.1 Construction of Regulatable Expression Vector mIL12bIL12aIL2DiaNHS76F8GMCSF-Thr A linker 1 (with an amino acid sequence as set forth in SEQ ID NO. 114) between the IL2 and the DiaNHS76F8 was replaced with a linker 2 (with an amino acid sequence as set forth in SEQ ID NO. 115), and a linker 3 (with an amino acid sequence as set forth in SEQ ID NO. 116) between the DiaNHS76F8 and the GMCSF was replaced with a linker 4 (with an amino acid sequence as set forth in SEQ ID NO. 117) to obtain an amino acid sequence of mIL12bIL12aIL2DiaNHS76F8GMCSF-Thr, wherein the linker 2 and the linker 4 had thrombin cleavage sites therein.

A gene coding sequence of mIL12bIL12aIL2DiaNHS76F8GMCSF-Thr with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 μg of mIL12bIL12aIL2DiaNHS76F8GMCSF-Thr plasmid, 4 μl of enzyme digestion buffer, 1 μl of BamHI and 1 μl of XhoI were added with water to a total volume of 40 μl, and let stand at 37° C. for 12 hours. An EP tube was taken out and added with 4.4 μl of 10× loading buffer; electrophoresis was performed by using 1% agarose gel; and after the electrophoresis, mIL12bIL12aIL2DiaNHS76F8GMCSF-Thr gene fragments were recovered for later use.

The amino acid sequence of the protein molecule mIL12bIL12aIL2DiaNHS76F8GMCSF-Thr is as set forth in SEQ ID NO. 70, and the nucleotide sequence encoding the mIL12bIL12aIL2DiaNHS76F8GMCSF-Thr is as set forth in SEQ ID NO. 111.

Enzyme digestion was performed on a regulatable expression vector pLentis-PTRE-MCS-PGK-PURO, with an enzyme digestion system as follows: 2 μg of pLentis-PTRE-MCS-PGK-PURO vector plasmid, 3 μl of enzyme digestion buffer, 1 μl of BamHI and 1 μl of XhoI were added with water to a total volume of 30 and let stand at 37° C. for 12 hours. The EP tube was taken out and added with 3.3 μl of 10× loading buffer; electrophoresis was performed by using 1% agarose gel; and after the electrophoresis, a pLentis-PTRE-MCS-PGK-PURO vector fragment was recovered for later use.

The pLentis-PTRE-MC S-PGK-PURO was linked to the mIL12bIL12aIL2DiaNHS76F8GMCSF-Thr, with a linking system including: 2 μl of pLentis-PTRE-MCS-PGK-PURO, 2 μl of mIL12bIL12aIL2DiaNHS76F8GMCSF-Thr, 1 μl of ligase buffer, 0.5 μl of T4DNA ligase, and 4.5 μl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL2DiaNHS76F8GMCSF-Thr-PGK-PURO was successfully constructed.

16.2 Preparation of Cells Capable of Regulating and Expressing mIL12bIL12aIL2DiaNHS76F8GMCSF-Thr A virus of an mIL12bIL12aIL2DiaNHS76F8GMCSF-Thr expression vector was prepared with a method the same as that for preparing the virus of the first expression vector, to obtain a virus of a second expression vector pLentis-PTRE-mIL12bIL12aIL2DiaNHS76F8GMCSF-Thr-PGK-PURO.

The cultured tumor cells B16 (rtTA) were digested, inoculated into a 6-well plate at $10^5$ cells/well, with a culture volume of 1 ml. After 24 hours, 10 μl of the virus of the second regulatable expression vector pLentis-PTRE-mIL12bIL12aIL2DiaNHS76F8GMCSF-Thr-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aIL2DiaN-HS76F8GMCSF-Thr, which were named as B16(rtTA)-mIL12bIL12aIL2DiaNHS76F8GMCSF-Thr.

Figure 33:
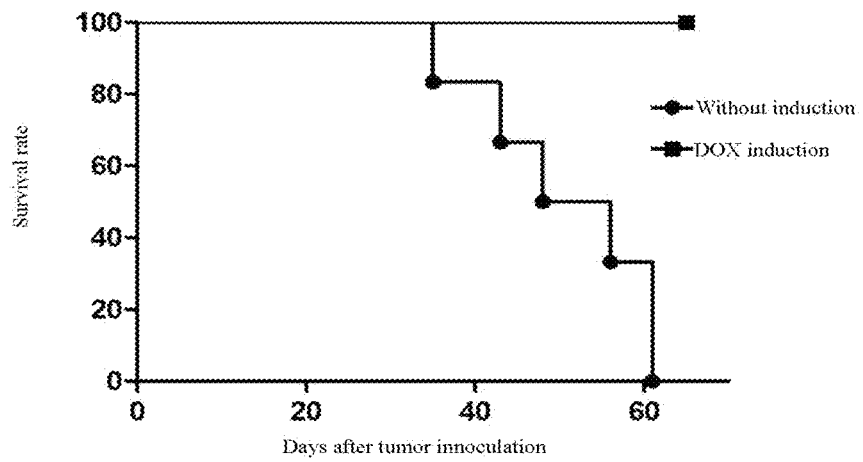
FIG. 33 shows the effect of a protein molecule mIL12bIL12aIL2DiaNHS76F8GMCSF-Thr on the survival rate of mice.

16.3 Effect of Induced Expression of mIL12bIL12aIL2DiaNHS76F8GMCSF-Thr on Tumor Growth The cells B16(rtTA)-mIL12bIL12aIL2GMCSFDiaN-HS76F8 in a logarithmic growth phase were digested, diluted with HBSS to $2\times10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the survival of the mice was recorded. As shown in FIG. 33, the induced expression of mIL12bIL12aIL2DiaNHS76F8GMCSF-Thr significantly improves the survival rate for the mice.

Example 17 Construction of Cells Expressing hIL12bIL12aDiaL19GMCSFIL2, hIL12bIL12aDiaNHS76GMCSFIL2, hIL12bIL12aDiaNHS76F8GMCSFIL2, hIL12bIL12aIL2DiaNHS76F8GMCSF, and hIL12bIL12aIL2DiaNHS76F8GMCSF-Thr 17.1 Construction of Vector Capable of Regulating and Expressing Target Gene In the EP tube, enzyme digestion was performed on the pLentis-CMV-MCS-IRES-PURO vector, with a system as follows: 2 µg of pLentis-CMV-MCS-IRES-PURO vector plasmid, 3 µl of enzyme digestion buffer, 1 µl of BamHI and 1 µl of XhoI were added with water to a total volume of 30 µl, and let stand at 37° C. for 12 hours. The EP tube was taken out and added with 3.3 µl of 10× loading buffer; electrophoresis was performed by using 1% agarose gel; and after the electrophoresis, a pLentis-CMV-MCS-IRES-PURO vector fragment was recovered for later use.

A linker 1 (with an amino acid sequence as set forth in SEQ ID NO. 114) between the IL2 and the DiaNHS76F8 was replaced with a linker 2 (with an amino acid sequence as set forth in SEQ ID NO. 115), and a linker 3 (with an amino acid sequence as set forth in SEQ ID NO. 116) between the DiaNHS76F8 and the GMCSF was replaced with a linker 4 (with an amino acid sequence as set forth in SEQ ID NO. 117) to obtain an amino acid sequence of hIL12bIL12aIL2DiaNHS76F8GMCSF-Thr, wherein the linker 2 and the linker 4 had thrombin cleavage sites therein.

The DNA sequences of hIL12bIL12aDiaL19GMCSFIL2, hIL12bIL12aDiaNHS76GMCSFIL2, hIL12bIL12-aDiaNHS76F8GMCSFIL2, hIL12bIL12aIL2Dia-NHS76F8GMCSF, and hIL12bIL12aIL2DiaNHS76F8G-MCSF-Thr were synthesized respectively, where during the synthesis, the restriction enzyme site BamHI or BglII was added to a 5'-terminal, and the restriction enzyme site XhoI or EcoRI was added to a 3'-terminal. The synthesized plasmid with the target gene was enzyme-digested, with a system as follows: 5 µg of plasmid, 4 µl of enzyme-digestion buffer, 1 µl of BamHI, and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, fragments were recovered for later use.

The amino acid sequence of the protein molecule hIL12bIL12aDiaL19GMCSFIL2 is as set forth in SEQ ID NO. 67, and the nucleotide sequence encoding the hIL12bIL12aDiaL19GMCSFIL2 is as set forth in SEQ ID NO. 108.

The amino acid sequence of the protein molecule hIL12bIL12aDiaNHS76GMCSFIL2 is as set forth in SEQ ID NO. 68, and the nucleotide sequence encoding the hIL12bIL12aDiaNHS76GMCSFIL2 is as set forth in SEQ ID NO. 109.

The amino acid sequence of the protein molecule hIL12bIL12aDiaNHS76F8GMCSFIL2 is as set forth in SEQ ID NO. 69, and the nucleotide sequence encoding the hIL12bIL12aDiaNHS76F8GMCSFIL2 is as set forth in SEQ ID NO. 110.

The amino acid sequence of the protein molecule hIL12bIL12aIL2DiaNHS76F8GMCSF is as set forth in SEQ ID NO. 65, and the nucleotide sequence encoding the hIL12bIL12aIL2DiaNHS76F8GMCSF is as set forth in SEQ ID NO. 106.

The amino acid sequence of the protein molecule hIL12bIL12aIL2DiaNHS76F8GMCSF-Thr is as set forth in SEQ ID NO. 71, and the nucleotide sequence encoding the hIL12bIL12aIL2DiaNHS76F8GMCSF-Thr is as set forth in SEQ ID NO. 112.

The pLentis-CMV-MCS-IRES-PURO was linked to the hIL12bIL12aDiaL19GMCSFIL2, hIL12bIL12a-DiaNHS76GMCSFIL2, hIL12bIL12aDiaNHS76F8G-MCSFIL2, hIL12bIL12aIL2DiaNHS76F8GMCSF, and hIL12bIL12aIL2DiaNHS76F8GMCSF-Thr respectively, with a linking system including: 2 µl of pLentis-CMV-MCS-IRES-PURO, 2 µl of gene fragment, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragments were successfully linked into the vector was identified by enzyme digestion. Then, the correct vectors were sent for sequencing to determine that the construction was successful, thereby obtaining the vector pLentis-CMV-hIL12bIL12aDiaL19GMCSFIL2-IRES-PURO, the vector pLentis-CMV-hIL12b IL12aDiaNHS76 GMCSFIL2-IRES-PURO, the vector pLentis-CMV-hIL12bIL12aDiaNHS76F8GMCSFIL2-IRES-PURO, the vector pLentis-CMV-hIL12bIL12aIL2DiaNHS76F8GM-CSF-IRES-PURO, and the vector pLentis-CMV-hIL12bIL12aIL2DiaNHS76F8GMCSF-Thr-IRES-PURO, which expressed the target gene.

17.2 Preparation of Virus of Expression Vector
1) The cultured 293FT cells were digested, counted and then plated into a 10 cm culture dish at $3\times10^6$ cells/well, where the volume of culture solution was 10 ml, and a total of five plates were spread.
2) In the evening of the second day, cellular states were observed, and transfection was performed if the cellular states were good. Chloroquine was added to the culture plates to a final concentration of 25 µM. A test tube was taken and added with sterile water and the following plasmids (6 µg of pMD2.G+15 µg of pSPAX2+20 µg of expression vector), until the total volume reached 1045

μl. Then 155 μl of 2M CaCl2 was added and mixed well. Finally, 1200 μl of 2×HBS was added by dripping over shaking. After the dripping was completed, a resulting mixture was quickly added to cell culture wells and gently shaken and mixed well.

3) In the morning of the third day, cellular states were observed, and the medium was changed to 10 ml of fresh DMEM medium.

4) In the morning of the fifth day, cellular states were observed. Supernatant in the culture dish was collected and filtered with a 0.45 μm filter, then placed in a high-speed centrifuge tube, and centrifuged at 50,000 g for 2 hours. The supernatant was carefully discarded, and the liquid was sucked to dryness with absorbent paper as much as possible. Then, 200 μl of HBSS was used for resuspension and precipitation. Precipitates were dissolved for 2 hours, then dispensed into small tubes, and stored at −70° C.

17.3 Transfection of 293A Cells with Expression Virus

The cultured 293A cells were digested, inoculated into a 6-well plate at $10^5$ cells/well, with a culture volume of 1 ml. After 24 hours, 10 μl of the virus expressing the above target gene was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 μg/ml. The culturing was continued by changing the medium every two days, where the concentration of the puromycin was maintained. After one week of screening, the survived cells were cells stably expressing the cytokines, and these cells were named as 293A (hIL12bIL12aDiaL19GMCSFIL2), 293A (hIL12bIL12aDiaNHS76GMCSFIL2), 293A (hIL12bIL12aDiaNHS76F8GMCSFIL2), 293A (hIL12bIL12aIL2DiaNHS76-F8GMCSF), and 293A (hIL12bIL12aIL2Dia-NHS76F8GMCSF-Thr), respectively.

Figure 34:
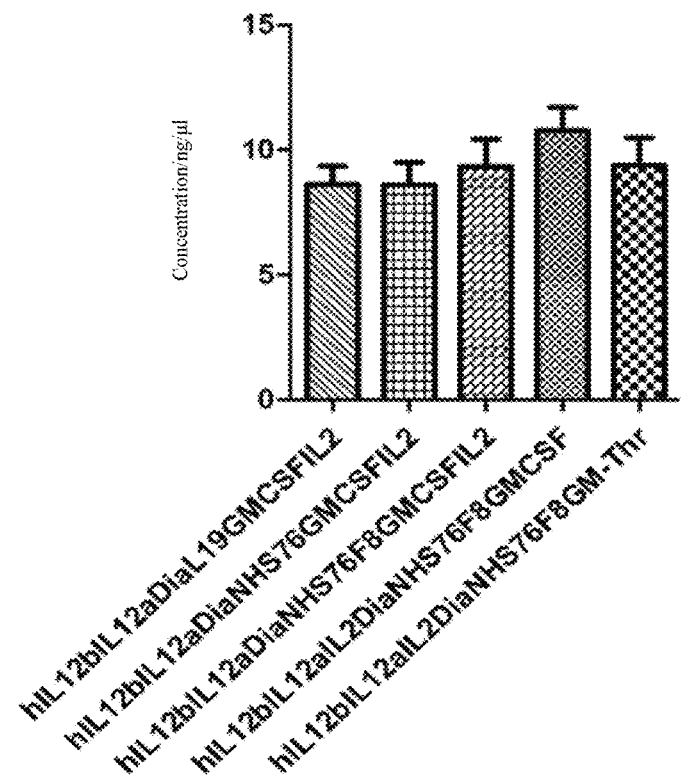
FIG. 34 shows the expression levels of protein molecules according to the present application.

The constructed expression cells were plated into a 24-well plate at $5 \times 10^4$ per well, and cultured for 96 hours. The supernatant was collected. The expression of the protein molecule in the supernatant was detected by using a human IL12p70 ELISA kit, where the operations were conducted according to the instructions of the kit. As shown in FIG. 34, these cells are capable of producing a large amount of IL12p70, and the cells expressing the protein molecules were successfully constructed.

Figure 35:
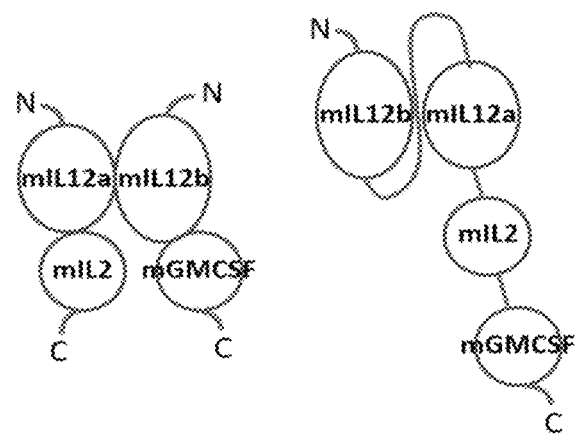
FIG. 35 shows the structures of a protein molecule mIL12bIL12aIL2GMCSF and a double-stranded fusion protein mIL12aIL2-IL12bGMCSF.

Example 18 Expression of Double-Stranded Fusion Protein mIL12aIL2-IL12bGMCSF 18.1 Construction of Expression Vector pLentis-CMV-mIL12aIL2-IL12bGMCSF-IRES-PURO The structure of the double-stranded fusion protein was as shown in FIG. 35. The gene coding sequence of mIL12aIL2-IL12bGMCSF was synthesized. The coding sequences of mIL12aIL2 and mIL12bGMCSF were linked via a self-cleaving peptide T2A therebetween, at which cleavage would occur after a peptide chain was expressed to form two peptide chains. A double-stranded fusion protein mIL12aIL2-IL12bGMCSF was formed between the two peptide chains. The synthesized sequence was provided with restriction enzyme sites BamHI and XhoI at the front and back ends respectively. The synthesized plasmid with the target gene was enzyme-digested, with a system as follows: 5 μg of mIL12aIL2-IL12bGMCSF plasmid, 4 μl of enzyme digestion buffer, 1 μl of BamHI and 1 μl of XhoI were added with water to a total volume of 40 μl, and let stand at 37° C. for 12 hours. An EP tube was taken out and added with 4.4 μl of 10× loading buffer; electrophoresis was performed by using 1% agarose gel; and after the electrophoresis, fragments were recovered for later use.

The amino acid sequence of the double-stranded fusion protein mIL12aIL2-IL12bGMCSF is as set forth in SEQ ID NO. 72 and SEQ ID NO. 118, and the nucleotide sequence encoding the mIL12aIL2-IL12bGMCSF is as set forth in SEQ ID NO. 113.

In the EP tube, enzyme digestion was performed on the pLentis-CMV-MCS-IRES-PURO vector, with a system as follows: 2 μg of pLentis-CMV-MCS-IRES-PURO vector plasmid, 3 μl of enzyme digestion buffer, 1 μl of BamHI and 1 μl of XhoI were added with water to a total volume of 30 μl, and let stand at 37° C. for 12 hours. The EP tube was taken out and added with 3.3 it of 10× loading buffer; electrophoresis was performed by using 1% agarose gel; and after the electrophoresis, pLentis-CMV-MCS-IRES-PURO vector fragments were recovered for later use.

mIL12aIL2-IL12bGMCSF was linked to pLentis-CMV-MCS-IRES-PURO in a system as follows: 2 μl of pLentis-CMV-MCS-IRES-PURO vector fragment, 2 μl of gene fragment, 1 μl of ligase buffer, 0.5 μl of T4 DNA ligase and 4.5 μl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the construction was successful. The expression vector pLentis-CMV-mIL12aIL2-IL12bGMCSF-IRES-PURO was obtained.

18.2 Preparation of Expression Viruses

1) The cultured 293FT cells were digested, counted and then plated into a 10 cm culture dish at $3 \times 10^6$ cells/well, where the volume of culture solution was 10 ml.

2) In the evening of the second day, cellular states were observed, and transfection was performed if the cellular states were good. Chloroquine was added to the culture plates to a final concentration of 25 μM. A test tube was taken and added with sterile water and the following plasmids (6 μg of pMD2.G+15 μg of pSPAX2+20 μg of expression vector), until the total volume reached 1045 μl. Then 155 μl of 2M CaCl2 was added and mixed well. Finally, 1200 μl of 2×HBS was added by dripping over shaking. After the dripping was completed, a resulting mixture was quickly added to cell culture wells and gently shaken and mixed well.

3) In the morning of the third day, cellular states were observed, and the medium was changed to 10 ml of fresh DMEM medium.

4) In the morning of the fifth day, cellular states were observed. Supernatant in the culture dish was collected and filtered with a 0.45 μm filter, then placed in a high-speed centrifuge tube, and centrifuged at 50,000 g for 2 hours. The supernatant was carefully discarded, and the liquid was sucked to dryness with absorbent paper as much as possible. Then, 200 μl of HBSS was used for resuspension and precipitation. Precipitates were dissolved for 2 hours, then dispensed into small tubes, and stored at −70° C.

18.3 Preparation of Expression Cells

The cultured 293A cells were digested, inoculated into a 6-well plate at $10^5$ cells/well, with a culture volume of 1 ml.

After 24 hours, 10 µl of the virus expressing the above target gene was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. The culturing was continued by changing the medium every two days, where the concentration of the puromycin was maintained. After one week of screening, the survived cells were cells stably expressing the protein, and these cells were named as 293A-mIL12aIL2-IL12bGMCSF.

The constructed expression cells were plated into a 24-well plate at 5×10$^4$ per well, and cultured for 96 hours. The supernatant was collected. The expression of the fusion protein in the supernatant was detected by using a human IL12p70 ELISA kit, where the operations were conducted according to the instructions of the kit. The expression detection results are shown in FIG. 36.

Example 19 Expression of Protein Molecule mIL12bIL12aIL2GMCSF 19.1 Construction of Expression Vector The schematic diagram of the protein molecule mIL12bIL12aIL2GMCSF was shown in FIG. 35. A DNA sequence corresponding to the gene was synthesized. Individual cytokines were linked by linkers 1 (with an amino acid sequence as set forth SEQ ID NO. 114) to form a long fusion peptide chain. The fusion gene had an IgG signal peptide at a front end, and the synthesized sequence was provided with restriction enzyme sites BamHI and XhoI at the front and back ends respectively. The synthesized plasmid with the target gene was enzyme-digested, with a system as follows: 5 µg of plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, fragments were recovered for later use.

In the EP tube, enzyme digestion was performed on the pLentis-CMV-MCS-IRES-PURO vector, with a system as follows: 2 µg of pLentis-CMV-MCS-IRES-PURO vector plasmid, 3 µl of enzyme digestion buffer, 1 µl of BamHI and 1 µl of XhoI were added with water to a total volume of 30 µl, and let stand at 37° C. for 12 hours. The EP tube was taken out and added with 3.3 µl of 10× loading buffer; electrophoresis was performed by using 1% agarose gel; and after the electrophoresis, pLentis-CMV-MCS-IRES-PURO vector fragments were recovered for later use.

The amino acid sequence of the protein molecule mIL12bIL12aIL2GMCSF is as set forth in SEQ ID NO. 32, and the nucleotide sequence encoding the mIL12bIL12aIL2GMCSF is as set forth in SEQ ID NO. 73.

A system for linking mIL12bIL12aIL2GMCSF and pLentis-CMV-MCS-IRES-PURO was as follows: 2 µl of pLentis-CMV-MCS-IRES-PURO vector fragments, 2 µl of gene fragments, 1 µl of ligase buffer, 0.5 µl of T4 DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the construction was successful. The expression vector pLentis-CMV-mIL12bIL12aIL2GMCSF-IRES-PURO was obtained.

19.2 Preparation of Expression Viruses

1) The cultured 293FT cells were digested, counted and then plated into a 10 cm culture dish at 3×10$^6$ cells/well, where the volume of culture solution was 10 ml.
2) In the evening of the second day, cellular states were observed, and transfection was performed if the cellular states were good. Chloroquine was added to the culture plates to a final concentration of 25 µM. A test tube was taken and added with sterile water and the following plasmids (6 µg of pMD2.G+15 µg of pSPAX2+20 µg of expression vector), until the total volume reached 1045 µl. Then 155 µl of 2M CaCl2 was added and mixed well. Finally, 1200 µl of 2×HBS was added by dripping over shaking. After the dripping was completed, a resulting mixture was quickly added to cell culture wells and gently shaken and mixed well.
3) In the morning of the third day, cellular states were observed, and the medium was changed to 10 ml of fresh DMEM medium.
4) In the morning of the fifth day, cellular states were observed. Supernatant in the culture dish was collected and filtered with a 0.45 µm filter, then placed in a high-speed centrifuge tube, and centrifuged at 50,000 g for 2 hours. The supernatant was carefully discarded, and the liquid was sucked to dryness with absorbent paper as much as possible. Then, 200 µl of HBSS was used for resuspension and precipitation. Precipitates were dissolved for 2 hours, then dispensed into small tubes, and stored at −70° C.

19.3 Preparation of Expression Cells

The cultured 293A cells were digested, inoculated into a 6-well plate at 10$^5$ cells/well, with a culture volume of 1 ml. After 24 hours, 10 µl of the virus expressing the above target gene was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. The culturing was continued by changing the medium every two days, where the concentration of the puromycin was maintained. After one week of screening, the survived cells were cells stably expressing the protein, and these cells were named as 293A-mIL12bIL12aIL2GMCSF.

The constructed expression cells were plated into a 24-well plate at 5×10$^4$ per well, and cultured for 96 hours. The supernatant was collected. The expression of the protein molecule in the supernatant was detected by using a human IL12p70 ELISA kit, where the operations were conducted according to the instructions of the kit. The expression detection results are shown in FIG. 36, and the yield of the protein molecule described in the present application is significantly higher than the yield of the double-stranded fusion protein.

Example 20 Effect of Induced Expression of mIL12bIL12aIL2GMCSF on Tumor Growth 20.1 Construction of regulatable expression vector mIL12bIL12aIL2GMCSF A gene coding sequence of mIL12bIL12aIL2GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aIL2GMCSF plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aIL2GMCSF gene fragments were recovered for later use.

The amino acid sequence of the protein molecule mIL12bIL12aIL2GMCSF is as set forth in SEQ ID NO. 32, and the nucleotide sequence encoding the mIL12bIL12aIL2GMCSF is as set forth in SEQ ID NO. 73.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL2GMCSF, with a linking system including: 2 µl of pLentis-PTRE-MCS-PGK-PURO, 2 µl of mIL12bIL12aIL2GMCSF, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL2GMCSF-PGK-PURO was successfully constructed.

20.2 Preparation of Cells Capable of Regulating and Expressing mIL12bIL12aIL2GMCSF A virus of an mIL12bIL12aIL2GMCSF expression vector was prepared with a method the same as that for preparing the virus of the first expression vector, to obtain a virus of a second expression vector pLentis-PTRE-mIL12bIL12aIL2GMCSF-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aIL2GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aIL2GMCSF, which were named as B16(rtTA)-mIL12bIL12aIL2GMCSF.

20.3 Effect of Induced Expression of mIL12bIL12aIL2GMCSF on Tumor Growth

The cells B16(rtTA)-mIL12bIL12aIL2GMCSF in a logarithmic growth phase were digested, diluted with HBSS to $2\times10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the survival of the mice was recorded. As shown in FIG. 37, the induced expression of mIL12bIL12aIL2GMCSF significantly improves the survival rate for the mice.

Example 21 Effect of Induced Expression of mIL12bIL12aGMCSFIL2 on Tumor Growth 21.1 Construction of Regulatable Expression Vector mIL12bIL12aGMCSFIL2

A gene coding sequence of mIL12bIL12aGMCSFIL2 with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aGMCSFIL2 plasmid, 4 µl of enzyme digestion buffer, 1 µl of BamHI and 1 µl of XhoI were added with water to a total volume of and let stand at 37° C. for 12 hours. An EP tube was taken out and added with 4.4 µl of 10× loading buffer; electrophoresis was performed by using 1% agarose gel; and after the electrophoresis, mIL12bIL12aGMCSFIL2 gene fragments were recovered for later use.

The amino acid sequence of the protein molecule mIL12bIL12aGMCSFIL2 is as set forth in SEQ ID NO. 40, and the nucleotide sequence encoding the mIL12bIL12aGMCSFIL2 is as set forth in SEQ NO 81.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 µl, and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aGMCSFIL2, with a linking system including: 2 µl of pLentis-PTRE-MCS-PGK-PURO, 2 µl of mIL12bIL12aGMCSFIL2, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aGMCSFIL2-PGK-PURO was successfully constructed.

21.2 Preparation of Cells Capable of Regulating and Expressing mIL12bIL12aGMCSFIL2

A virus of an mIL12bIL12aGMCSFIL2 expression vector was prepared with a method the same as that for preparing the virus of the first expression vector, to obtain a virus of a second expression vector pLentis-PTRE-mIL12bIL12aGMCSFIL2-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTREmIL12bIL12aGMCSFIL2-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aGMCSFIL2, which were named as B16(rtTA)-mIL12bIL12aGMCSFIL2.

21.3 Effect of Induced Expression of mIL12bIL12aGMCSFIL2 on Tumor Growth

The cells B16(rtTA)-mIL12bIL12aGMCSFIL2 in a logarithmic growth phase were digested, diluted with HBSS to $2 \times 10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the survival of the mice was recorded. As shown in FIG. 38, the induced expression of mIL12bIL12aGMCSFIL2 significantly improves the survival rate for the mice.

Example 22 Effect of Induced Expression of mIL12bIL12aIL7GMCSF on Tumor Growth 22.1 Construction of Regulatable Expression Vector mIL12bIL12aIL7GMCSF A gene coding sequence of mIL12bIL12aIL7GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aIL7GMCSF plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aIL7GMCSF gene fragments were recovered for later use.

The amino acid sequence of the protein molecule mIL12bIL12aIL7GMCSF is as set forth in SEQ ID NO. 33, and the nucleotide sequence encoding the mIL12bIL12aIL7GMCSF is as set forth in SEQ ID NO. 74.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 µl, and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL7GMCSF, with a linking system including: 2 µl of pLentis-PTRE-MCS-PGK-PURO, 2 µl of mIL12bIL12aIL7GMCSF, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL7GMCSF-PGK-PURO was successfully constructed.

22.2 Preparation of Cells Capable of Regulating and Expressing mIL12bIL12aIL7GMCSF A virus of an mIL12bIL12aIL7GMCSF expression vector was prepared with a method the same as that for preparing the virus of the first expression vector, to obtain a virus of a second expression vector pLentis-PTRE-mIL12bIL12aIL7GMCSF-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aIL7GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aIL7GMCSF, which were named as B16(rtTA)-mIL12bIL12aIL7GMCSF.

22.3 Effect of Induced Expression of mIL12bIL12aIL7GMCSF on Tumor Growth

Figure 39:
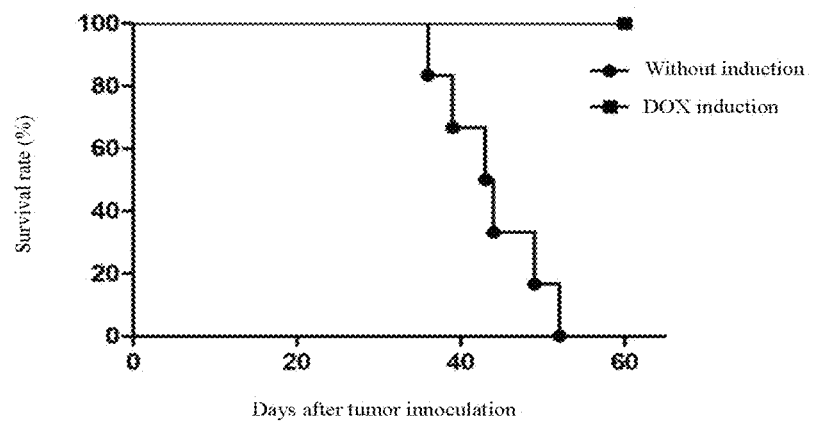
FIG. 39 shows the effect of a protein molecule mIL12bIL12aIL7GMCSF on the survival rate of mice.

The cells B16(rtTA)-mIL12bIL12aIL7GMCSF in a logarithmic growth phase were digested, diluted with HBSS to $2 \times 10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the survival of the mice was recorded. As shown in FIG. 39, the induced expression of mIL12bIL12aIL7GMCSF significantly improves the survival rate for the mice.

Example 23 Effect of Induced Expression of mIL12bIL12aIL15GMCSF on Tumor Growth 23.1 Construction of Regulatable Expression Vector mIL12bIL12aIL15GMCSF A gene coding sequence of mIL12bIL12aIL15GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aIL15GMCSF plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aIL15GMCSF gene fragments were recovered for later use.

The amino acid sequence of the protein molecule mIL12bIL12aIL15GMCSF is as set forth in SEQ ID NO. 34, and the nucleotide sequence encoding the mIL12bIL12aIL15GMCSF is as set forth in SEQ ID NO. 75.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 µl, and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL15GMCSF, with a linking system including: 2 µl of pLentis-PTRE-MCS-PGK-PURO, 2 µl of mIL12bIL12aIL15GMCSF, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL15GMCSF-PGK-PURO was successfully constructed.

23.2 Preparation of Cells Capable of Regulating and Expressing mIL12bIL12aIL15GMCSF A virus of an mIL12bIL12aIL15GMCSF expression vector was prepared with a method the same as that for preparing the virus of the first expression vector, to obtain a virus of a second expression vector pLentis-PTRE-mIL12bIL12aIL15GMCSF-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aIL15GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aIL15GMCSF, which were named as B16(rtTA)-mIL12bIL12aIL15GMCSF.

23.3 Effect of Induced Expression of mIL12bIL12aIL15GMCSF on Tumor Growth

Figure 40:
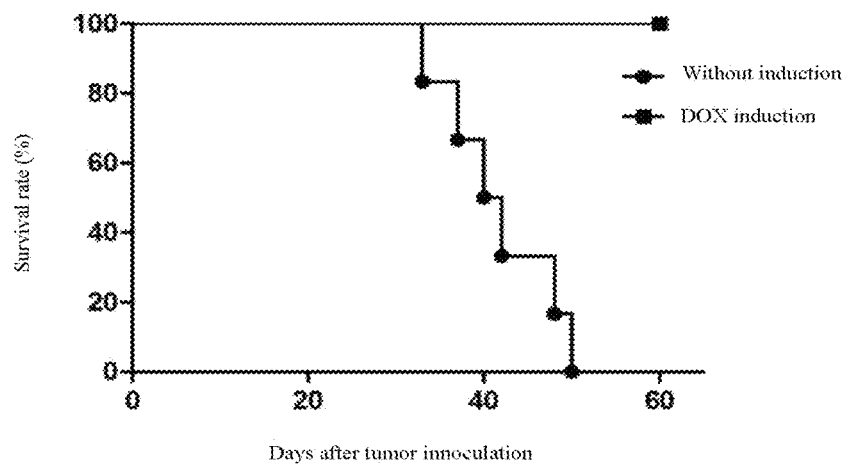
FIG. 40 shows the effect of a protein molecule mIL12bIL12aIL15GMCSF on the survival rate of mice.

The cells B16(rtTA)-mIL12bIL12aIL15GMCSF in a logarithmic growth phase were digested, diluted with HBSS to $2 \times 10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the survival of the mice was recorded. As shown in FIG. 40, the induced expression of mIL12bIL12aIL15GMCSF significantly improves the survival rate for the mice.

Example 24 Effect of Induced Expression of mIL12bIL12aIL21GMCSF on Tumor Growth 24.1 Construction of Regulatable Expression Vector mIL12bIL12aIL21GMCSF A gene coding sequence of mIL12bIL12aIL21GMCSF with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aIL21GMCSF plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aIL21GMCSF gene fragments were recovered for later use.

The amino acid sequence of the protein molecule mIL12bIL12aIL21GMCSF is as set forth in SEQ ID NO. 35, and the nucleotide sequence encoding the mIL12bIL12aIL21GMCSF is as set forth in SEQ ID NO. 76.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL21GMCSF, with a linking system including: 2 µl of pLentis-PTRE-MCS-PGK-PURO, 2 µl of mIL12bIL12aIL21GMCSF, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12IL12aIL21GMCSF-PGK-PURO was successfully constructed.

24.2 Preparation of Cells Capable of Regulating and Expressing mIL12bIL12aIL21GMCSF A virus of an mIL12bIL12aIL21GMCSF expression vector was prepared with a method the same as that for preparing the virus of the first expression vector, to obtain a virus of a second expression vector pLentis-PTRE-mIL12bIL12aIL21GMCSF-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aIL21GMCSF-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aIL21GMCSF, which were named as B16(rtTA)-mIL12bIL12aIL21GMCSF.

24.3 Effect of Induced Expression of mIL12bIL12aIL21GMCSF on Tumor Growth

Figure 41:
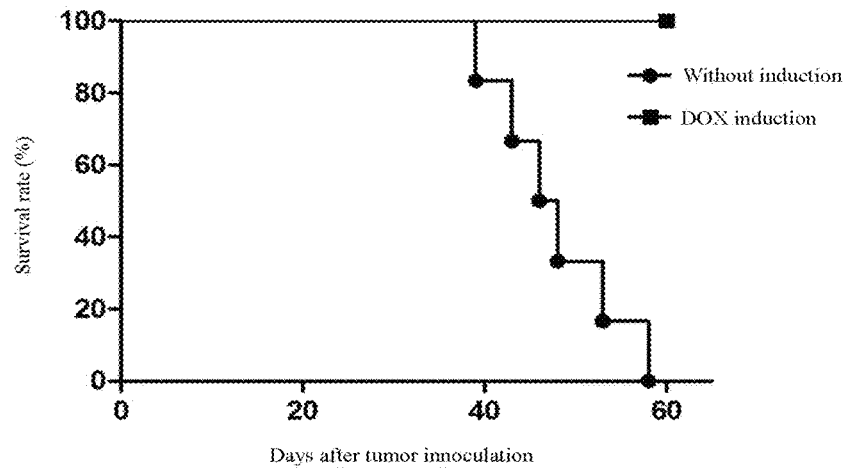
FIG. 41 shows the effect of a protein molecule mIL12bIL12aIL21GMCSF on the survival rate of mice.

The cells B16(rtTA)-mIL12bIL12aIL21GMCSF in a logarithmic growth phase were digested, diluted with HBSS to $2 \times 10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the survival of the mice was recorded. As shown in FIG. 41, the induced expression of mIL12bIL12aIL21GMCSF significantly improves the survival rate for the mice.

Example 25 Effect of Induced Expression of mIL12bIL12aIL2FLT3L on Tumor Growth 25.1 Construction of Regulatable Expression Vector mIL12bIL12aIL2FLT3L A gene coding sequence of mIL12bIL12aIL2FLT3L with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aIL2FLT3L plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aIL2FLT3L gene fragments were recovered for later use.

The amino acid sequence of the protein molecule mIL12bIL12aIL2FLT3L is as set forth in SEQ ID NO. 36, and the nucleotide sequence encoding the mIL12bIL12aIL2FLT3L is as set forth in SEQ ID NO. 77.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 µl, and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL2FLT3L, with a linking system including: 2 µl of pLentis-PTRE-MCS-PGK-PURO, 2 µl of mIL12bIL12aIL2FLT3L, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL2FLT3L-PGK-PURO was successfully constructed.

25.2 Preparation of Cells Capable of Regulating and Expressing mIL12bIL12aIL2FLT3L A virus of an mIL12bIL12aIL2FLT3L expression vector was prepared with a method the same as that for preparing the virus of the first expression vector, to obtain a virus of a second expression vector pLentis-PTRE-mIL12bIL12aIL2FLT3L-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aIL2FLT3L-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aIL2FLT3L, which were named as B16(rtTA)-mIL12bIL12aIL2FLT3L.

25.3 Effect of Induced Expression of mIL12bIL12aIL2FLT3L on Tumor Growth

Figure 42:
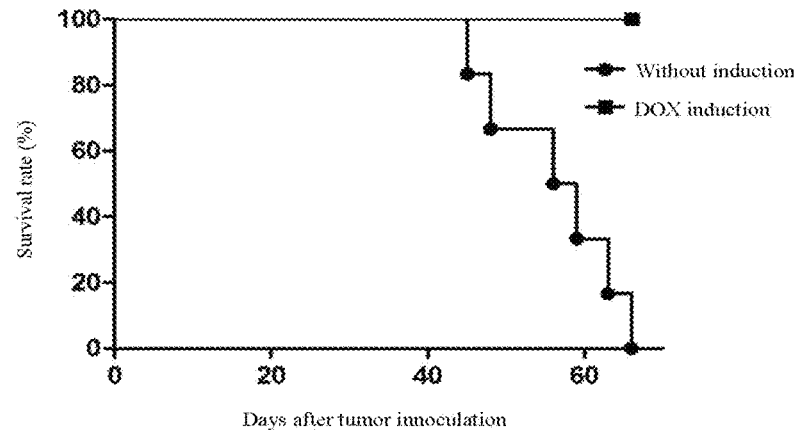
FIG. 42 shows the effect of a protein molecule mIL12bIL12aIL2FLT3L on the survival rate of mice.

The cells B16(rtTA)-mIL12bIL12aIL2FLT3L in a logarithmic growth phase were digested, diluted with HBSS to $2\times10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the survival of the mice was recorded. As shown in FIG. 42, the induced expression of mIL12bIL12aIL2FLT3L significantly improves the survival rate for the mice.

Example 26 Effect of Induced Expression of mIL12bIL12aIL7FLT3L on Tumor Growth 26.1 Construction of Regulatable Expression Vector mIL12bIL12aIL7FLT3L A gene coding sequence of mIL12bIL12aIL7FLT3L with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aIL7FLT3L plasmid, 4 µl of enzyme digestion buffer, 1 µl of BamHI and 1 µl of XhoI were added with water to a total volume of 400, and let stand at 37° C. for 12 hours. An EP tube was taken out and added with 4.4 µl of 10× loading buffer; electrophoresis was performed by using 1% agarose gel; and after the electrophoresis, mIL12bIL12aIL7FLT3L gene fragments were recovered for later use.

The amino acid sequence of the protein molecule mIL12bIL12aIL7FLT3L is as set forth in SEQ ID NO. 37, and the nucleotide sequence encoding the mIL12bIL12aIL7FLT3L is as set forth in SEQ ID NO. 78.

Enzyme digestion was performed on a regulatable expression vector pLentis-PTRE-MCS-PGK-PURO, with an enzyme digestion system as follows: 2 µg of pLentis-PTRE-MCS-PGK-PURO vector plasmid, 3 µl of enzyme digestion buffer, 1 µl of BamHI and 1 µl of XhoI were added with water to a total volume of 30 and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL7FLT3L, with a linking system including: 2 µl of pLentis-PTRE-MCS-PGK-PURO, 2 µl of mIL12bIL12aIL7FLT3L, 1 µl of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL7FLT3L-PGK-PURO was successfully constructed.

26.2 Preparation of Cells Capable of Regulating and Expressing mIL12bIL12aIL7FLT3L A virus of an mIL12bIL12aIL7FLT3L expression vector was prepared with a method the same as that for preparing the virus of the first expression vector, to obtain a virus of a second expression vector pLentis-PTRE-mIL12bIL12aIL7FLT3L-PGK-PURO The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aIL7FLT3L-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aIL7FLT3L, which were named as B16(rtTA)-mIL12bIL12aIL7FLT3L.

26.3 Effect of Induced Expression of mIL12bIL12aIL7FLT3L on Tumor Growth

Figure 43:
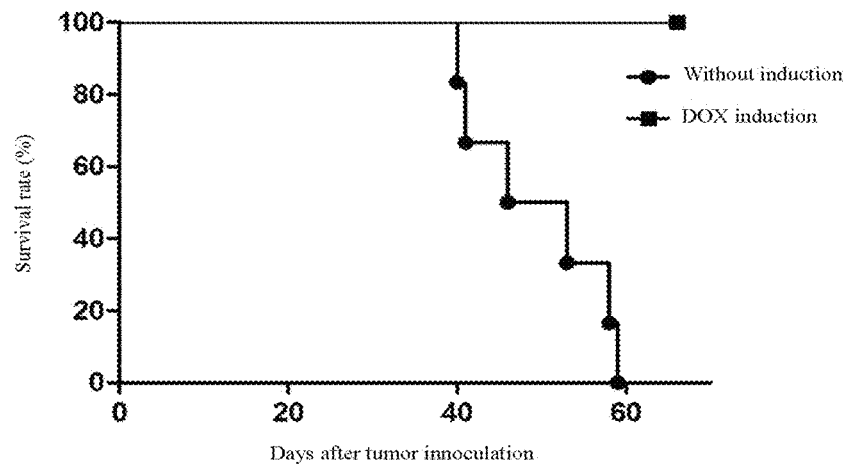
FIG. 43 shows the effect of a protein molecule mIL12bIL12aIL7FLT3L on the survival rate of mice.

The cells B16(rtTA)-mIL12bIL12aIL7FLT3L in a logarithmic growth phase were digested, diluted with HBSS to $2\times10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the survival of the mice was recorded. As shown in FIG. 43, the induced expression of mIL12bIL12aIL7FLT3L significantly improves the survival rate for the mice.

Example 27 Effect of Induced Expression of mIL12bIL12aIL15FLT3L on Tumor Growth 27.1 Construction of Regulatable Expression Vector mIL12bIL12aIL15FLT3L A gene coding sequence of mIL12bIL12aIL15FLT3L with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aIL15FLT3L plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aIL15FLT3L gene fragments were recovered for later use.

The amino acid sequence of the protein molecule mIL12bIL12aIL15FLT3L is as set forth in SEQ ID NO. 38, and the nucleotide sequence encoding the mIL12bIL12aIL15FLT3L is as set forth in SEQ ID NO. 79.

Enzyme digestion was performed on a regulatable expression vector pLentis-PTRE-MCS-PGK-PURO, with an enzyme digestion system as follows: 2 ng of pLentis-PTRE-MCS-PGK-PURO vector plasmid, 3 µl of enzyme digestion buffer, 1 µl of BamHI and 1 µl of XhoI were added with water to a total volume of 30 and let stand at 37° C. for 12 hours. The EP tube was taken out and added with 3.3 µl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL15FLT3L, with a linking system including: 2 µl of pLentis-PTRE-MCS-PGK-PURO, 2 µl of mIL12bIL12aIL15FLT3L, 1 of ligase buffer, 0.5 µl of T4DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL15FLT3L-PGK-PURO was successfully constructed.

27.2 Preparation of Cells Capable of Regulating and Expressing mIL12bIL12aIL15FLT3L A virus of an mIL12bIL12aIL15FLT3L expression vector was prepared with a method the same as that for preparing the virus of the first expression vector, to obtain a virus of a second expression vector pLentis-PTRE-mIL12bIL12aIL15FLT3L-PGK-PURO.

The cultured tumor cells B16 (rtTA) were digested, inoculated into a 6-well plate at $10^5$ cells/well, with a culture volume of 1 ml. After 24 hours, 10 µl of the virus of the second regulatable expression vector pLentis-PTRE-mIL12bIL12aIL15FLT3L-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. After the culturing was continued for three days, the survived cells were the cells capable of regulating and expressing the mIL12bIL12aIL15FLT3L, which were named as B16(rtTA)-mIL12bIL12aIL15FLT3L.

27.3 Effect of Induced Expression of mIL12bIL12aIL15FLT3L on Tumor Growth

Figure 44:
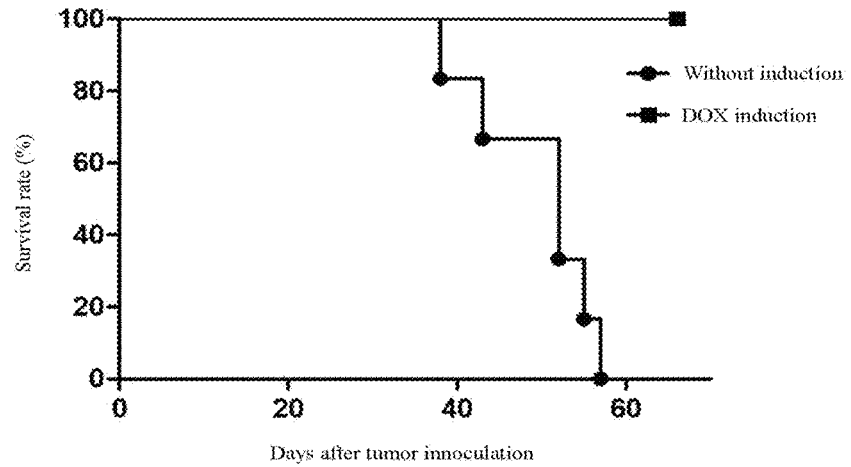
FIG. 44 shows the effect of a protein molecule mIL12bIL12aIL15FLT3L on the survival rate of mice.

The cells B16(rtTA)-mIL12bIL12aIL15FLT3L in a logarithmic growth phase were digested, diluted with HBSS to $2\times10^6$ cells/ml, and injected into the right backs of a total of 10 C57BL/6 female mice being 8-10 weeks old at 50 µl/mouse by using a 1 ml syringe. After tumors grew, the mice were fed with water containing 2 g/L doxycycline, and the survival of the mice was recorded. As shown in FIG. 44, the induced expression of mIL12bIL12aIL15FLT3L significantly improves the survival rate for the mice.

Example 28 Effect of Induced Expression of mIL12bIL12aIL21FLT3L on Tumor Growth 28.1 Construction of Regulatable Expression Vector mIL12bIL12aIL21FLT3L A gene coding sequence of mIL12bIL12aIL21FLT3L with BamHI or BglII and XhoI or EcoRI restriction enzyme sites on both ends were synthesized. Then, enzyme digestion was performed by using BamHI or BglII and XhoI or EcoRI, with an enzyme digestion system as follows: 5 µg of mIL12bIL12aIL21FLT3L plasmid, 4 µl of enzyme digestion buffer, 1 µl of BamHI and 1 µl of XhoI were added with water to a total volume of 40 µl, and let stand at 37° C. for 12 hours. An EP tube was taken out and added with 4.4 µl of 10× loading buffer; electrophoresis was performed by using 1% agarose gel; and after the electrophoresis, mIL12bIL12aIL21FLT3L gene fragments were recovered for later use.

The amino acid sequence of the protein molecule mIL12bIL12aIL21FLT3L is as set forth in SEQ ID NO. 39, and the nucleotide sequence encoding the mIL12bIL12aIL21FLT3L is as set forth in SEQ ID NO. 80.

Enzyme digestion was performed on a regulatable expression vector pLentis-PTRE-MCS-PGK-PURO, with an enzyme digestion system as follows: 2 μg of pLentis-PTRE-MCS-PGK-PURO vector plasmid, 3 μl of enzyme digestion buffer, 1 μl of BamHI and 1 μl of XhoI were added with water to a total volume of 30 μl, and let stand at 37° C. for 12 hours. The EP tube was taken out and added with 3.3 μl of 10× loading buffer; electrophoresis was performed by using 1% agarose gel; and after the electrophoresis, a pLentis-PTRE-MCS-PGK-PURO vector fragment was recovered for later use.

The pLentis-PTRE-MCS-PGK-PURO was linked to the mIL12bIL12aIL21FLT3L, with a linking system including: 2 μl of pLentis-PTRE-MCS-PGK-PURO, 2 μl of mIL12bIL12aIL21FLT3L, 1 μl of ligase buffer, 0.5 μl of T4DNA ligase, and 4.5 μl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the second expression vector pLentis-PTRE-mIL12bIL12aIL21FLT3L-PGK-PURO was successfully constructed.

28.2 Preparation of Cells Capable of Regulating and Expressing mIL12bIL12aIL21FLT3L A virus of an mIL12bIL12aIL21FLT3L expression vector was prepared with a method the same as that for preparing the virus of the first expression vector, to obtain a virus of a second expression vector pLentis-PTRE-mIL12bIL12aIL21FLT3L-PGK-PURO.

The cultured tumor cells B16 (rtTA) were digested, inoculated into a 6-well plate at $10^5$ cells/well, with a culture volume of 1 ml. After 24 hours, 10 μl of the virus of the second regulatable expression vector pLentis-PTRE-mIL12bIL12aIL21FLT3L-PGK-PURO was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 μg/ml. After the culturing was continued for three days, the survived cells were the cells capable of regulating and expressing the mIL12bIL12aIL21FLT3L, which were named as B16(rtTA)-mIL12bIL12aIL21FLT3L.

28.3 Effect of Induced Expression of mIL12bIL12aIL21FLT3L on Tumor Growth

Figure 45:
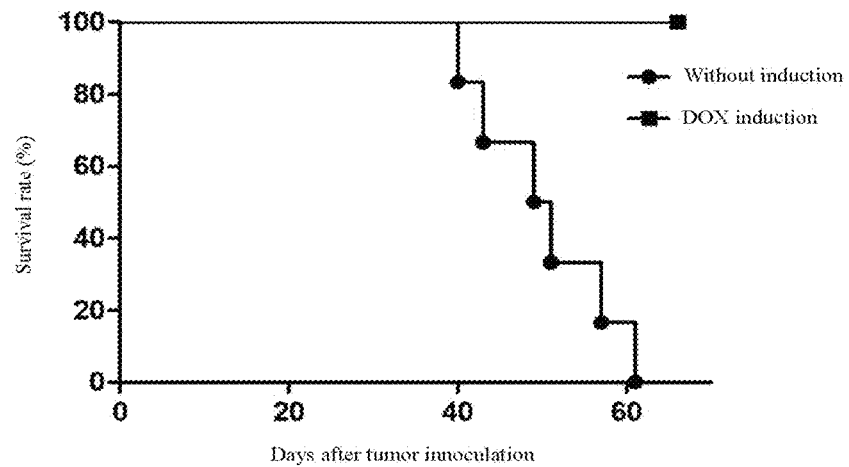
FIG. 45 shows the effect of a protein molecule mIL12bIL12aIL21FLT3L on the survival rate of mice.

The cells B16(rtTA)-mIL12bIL12aIL21FLT3L in a logarithmic growth phase were digested, diluted with HBSS to $2 \times 10^6$ cells/ml, and injected into the right backs of a total of 10 C57BL/6 female mice being 8-10 weeks old at 50 μl/mouse by using a 1 ml syringe. After tumors grew, the mice were fed with water containing 2 g/L doxycycline, and the survival of the mice was recorded. As shown in FIG. 45, the induced expression of mIL12bIL12aIL21FLT3L significantly improves the survival rate for the mice.

Example 29 Therapeutic Effect of Intratumoral Injection of mIL12bIL12aIL2GMCSF on Lung Cancer in Mice 29.1 Preparation of mIL12bIL12aIL2GMCSF The constructed mIL12bIL12aIL2GMCSF-expressing cells 293A-mIL12bIL12aIL2GMCSF were passaged to a 15 cm culture dish. After the cells grew all over, the medium was changed to 30 ml of CDM4HEK293, and the culturing was continued for 5 days. Then the supernatant was collected, filtered with a 0.45 urn filter, and then ultrafiltered and concentrated by 30 times with 50 kd AMICON ULTRA-15 to obtain 1 ml of a protein solution. Protein concentration was detected with an IL12p70 ELISA kit, and the protein was dispensed and stored at −20° C.

29.2 Treatment of Tumor

The cultured mouse lung cancer cells (LLC) were digested, and $5 \times 10^5$ cells were subcutaneously injected into the right body sides of C57BL/6 mice. Treatment was started when the long diameter of each tumor reached about 5 mm.

3 ug of the protein was taken based on the protein concentration and diluted to 35 μl with sterile water. Then, 65 μl of glycerin was added, and mixed well under the careful blowing of a pipette tip. A prepared protein solution was sucked by using a 29G insulin syringe, and slowly injected into a tumor. After the injection, a needle was retained for a while to reduce the overflow of the solution. After the injection, the mice were returned to a cage, and the survival of the mice was recorded. The mice injected only with 65% glycerol were used as controls.

Figure 46:
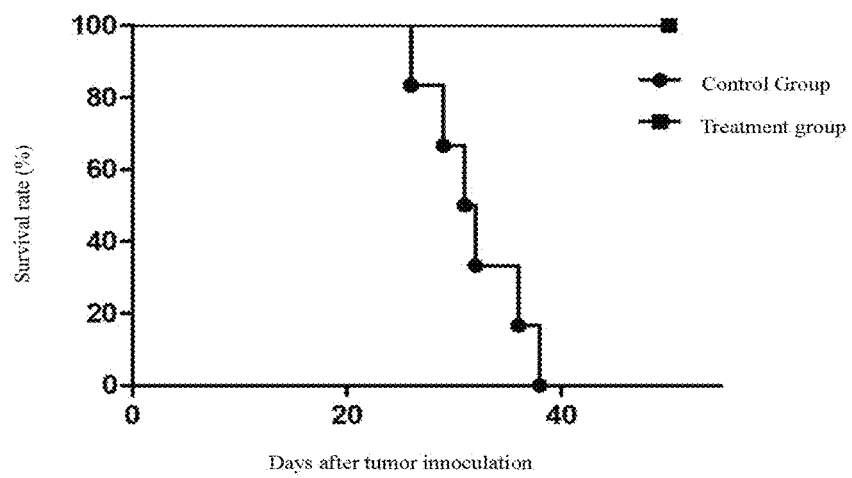
FIG. 46 shows the effect of intratumoral injection of mIL12bIL12aIL2GMCSF on the survival rate of mice.

The experimental results are shown in FIG. 46. The treatment with mIL12bIL12aIL2GMCSF significantly improves the survival rate of mice.

Example 30 Construction of Cells Expressing hIL12bIL12aIL2GMCSF, hIL12bIL12aIL7GMCSF, hIL12bIL12aIL15GMCSF, hIL12bIL12aIL21GMCSF, hIL12bIL12aIL2FLT3L, hIL12bIL12aIL7FLT3L, hIL12bIL12aIL15FLT3L, and hIL12bIL12aIL21FLT3L In the EP tube, enzyme digestion was performed on the pLentis-CMV-MCS-IRES-PURO vector, with a system as follows: 2 μg of plasmid, 3 μl of enzyme digestion buffer, 1 μl of BamHI and 1 μl of XhoI were added with water to a total volume of 30 μl, and let stand at 37° C. for 12 hours. An EP tube was taken out and added with 3.3 μl of 10× loading buffer; electrophoresis was performed by using 1% agarose gel; and after the electrophoresis, vector fragments were recovered for later use.

The DNA sequences of hIL12bIL12aIL2GMCSF, hIL12bIL12aIL7GMCSF, hIL12bIL12aIL15GMCSF, hIL12bIL12aIL21GMCSF, hIL12bIL12aIL2FLT3L, hIL12bIL12aIL7FLT3L, hIL12bIL12aIL15FLT3L, and hIL12bIL12aIL21FLT3L were synthesized respectively, wherein during the synthesis, the enzyme digestion site BamHI or BglII was added to a 5'-terminal, and the enzyme digestion site XhoI or EcoRI was added to a 3'-terminal. The synthesized plasmid with the target gene was enzyme-digested, with a system as follows: 5 μg of plasmid, 4 μl of enzyme-digestion buffer, 1 μl of BamHI, and 1 μl of XhoI were added with water to a total volume of 40 μl, and let stand at 37° C. for 12 hours. An EP tube was taken out and added with 4.4 μl of 10× loading buffer; electrophoresis was performed by using 1% agarose gel; and after the electrophoresis, fragments were recovered for later use.

The amino acid sequence of the protein molecule hIL12bIL12aIL2GMCSF is as set forth in SEQ ID NO. 41, and the nucleotide sequence encoding the hIL12bIL12aIL2GMCSF is as set forth in SEQ ID NO. 82.

The amino acid sequence of the protein molecule hIL12bIL12aIL7GMCSF is as set forth in SEQ ID NO. 42, and the nucleotide sequence encoding the hIL12bIL12aIL7GMCSF is as set forth in SEQ ID NO. 83.

The amino acid sequence of the protein molecule hIL12bIL12aIL15GMCSF is as set forth in SEQ ID NO. 43, and the nucleotide sequence encoding the hIL12bIL12aIL15GMCSF is as set forth in SEQ ID NO. 84.

The amino acid sequence of the protein molecule hIL12bIL12aIL21GMCSF is as set forth in SEQ ID NO. 44, and the nucleotide sequence encoding the hIL12bIL12aIL21GMCSF is as set forth in SEQ ID NO. 85.

The amino acid sequence of the protein molecule hIL12bIL12aIL2FLT3L is as set forth in SEQ ID NO. 45, and the nucleotide sequence encoding the hIL12bIL12aIL2FLT3L is as set forth in SEQ ID NO. 86.

The amino acid sequence of the protein molecule hIL12bIL12aIL7FLT3L is as set forth in SEQ ID NO. 46, and the nucleotide sequence encoding the hIL12bIL12aIL7FLT3L is as set forth in SEQ ID NO. 87.

The amino acid sequence of the protein molecule hIL12bIL12aIL15FLT3L is as set forth in SEQ ID NO. 47, and the nucleotide sequence encoding the hIL12bIL12aIL15FLT3L is as set forth in SEQ ID NO. 88.

The amino acid sequence of the protein molecule hIL12bIL12aIL21FLT3L is as set forth in SEQ ID NO. 48, and the nucleotide sequence encoding the hIL12bIL12aIL21FLT3L is as set forth in SEQ ID NO. 89.

A system for linking pLentis-CMV-MCS-IRES-PURO p hIL12bIL12aIL2GMCSF, hIL12bIL12aIL7GMCSF, hIL12bIL12aIL15GMCSF, hIL12bIL12aIL21GMCSF, hIL12bIL12aIL2FLT3L, hIL12bIL12aIL7FLT3L, hIL12bIL12aIL15FLT3L, and hIL12bIL12aIL21FLT3L was as follows: 2 µl of pLentis-CMV-MCS-IRES-PURO, 2 µl of gene fragments, 1 µl of ligase buffer, 0.5 µl of T4 DNA ligase, and 4.5 µl of water. The mixture was left at room temperature for linkage for 4 hours. Then, the linking system was subjected to competent *Escherichia coli* transformation. On the second day, colonies were picked from the transformed plate, placed in an LB medium, and cultured overnight in a shaker at 37° C. Plasmids were extracted from cultured bacteria by using a plasmid extraction kit. Whether the fragment was successfully linked into the vector was identified by enzyme digestion. Then, the correct vector was sent for sequencing to determine that the construction was successful. The virus vectors pLentis-CMV-hIL12bIL12aIL2GMCSF-IRES-PURO, pLentis-CMV-hIL12bIL12aIL7GMCSF-IRES-PURO, pLentis-CMV-hIL12bIL12aIL15GMCSF-IRES-PURO, pLentis-CMV-hIL12bIL12aIL21GMCSF-IRES-PURO, pLentis-CMV-hIL12bIL12aIL2FLT3L-IRES-PURO, pLentis-CMV-hIL12bIL12aIL7FLT3L-IRES-PURO, pLentis-CMV-hIL12bIL12aIL15FLT3L-IRES-PURO, and pLentis-CMV-hIL12bIL12aIL21FLT3L-IRES-PURO expressing the target gene were obtained.

The virus of the expression vector was prepared with a step as follows:

1) The cultured 293FT cells were digested, counted and then plated into a 10 cm culture dish at $3\times10^6$ cells/well, where the volume of culture solution was 10 ml, and a total of five plates were spread.
2) In the evening of the second day, cellular states were observed, and transfection was performed if the cellular states were good. Chloroquine was added to the culture plates to a final concentration of 25 µM. A test tube was taken and added with sterile water and the following plasmids (6 µg of pMD2.G+15 ng of pSPAX2+20 µg of expression vector), until the total volume reached 1045 µl. Then 155 µl of 2M CaCl2 was added and mixed well. Finally, 1200 µl of 2×HBS was added by dripping over shaking. After the dripping was completed, a resulting mixture was quickly added to cell culture wells and gently shaken and mixed well.
3) In the morning of the third day, cellular states were observed, and the medium was changed to 10 ml of fresh DMEM medium.
4) In the morning of the fifth day, cellular states were observed. Supernatant in the culture dish was collected and filtered with a 0.45 µm filter, then placed in a high-speed centrifuge tube, and centrifuged at 50,000 g for 2 hours. The supernatant was carefully discarded, and the liquid was sucked to dryness with absorbent paper as much as possible. Then, 200 µl of HBSS was used for resuspension and precipitation. Precipitates were dissolved for 2 hours, then dispensed into small tubes, and stored at −70° C.

The 293A cells was transfected with the expression virus by a method as follows. The cultured 293A cells were digested, inoculated into a 6-well plate at 105 cells/well, with a culture volume of 1 ml. After 24 hours, 10 µl of the expression virus was added. After the resulting mixture was continuously incubated in an incubator for 24 hours, supernatant was discarded and replaced with fresh medium to continue culturing. After the cells grew all over, the cells were transferred to a culture flask. Puromycin was added at a final concentration of 3 µg/ml. The culturing was continued by changing the medium every two days, where the concentration of the puromycin was maintained. After one week of screening, the survived cells were cells stably expressing the cytokines, and these cells were named as 293A (hIL12bIL12aIL2GMCSF), 293A (hIL12bIL12aIL7GMCSF), 293A (hIL12bIL12aIL15GMCSF), 293A (hIL12bIL12aIL21GMCSF), 293A (hIL12bIL12aIL2FLT3L), 293A (hIL12bIL12aIL7FLT3L), 293A (hIL12bIL12aIL15FLT3L), 293A (hIL12bIL12aIL21FLT3L), respectively.

Figure 47:
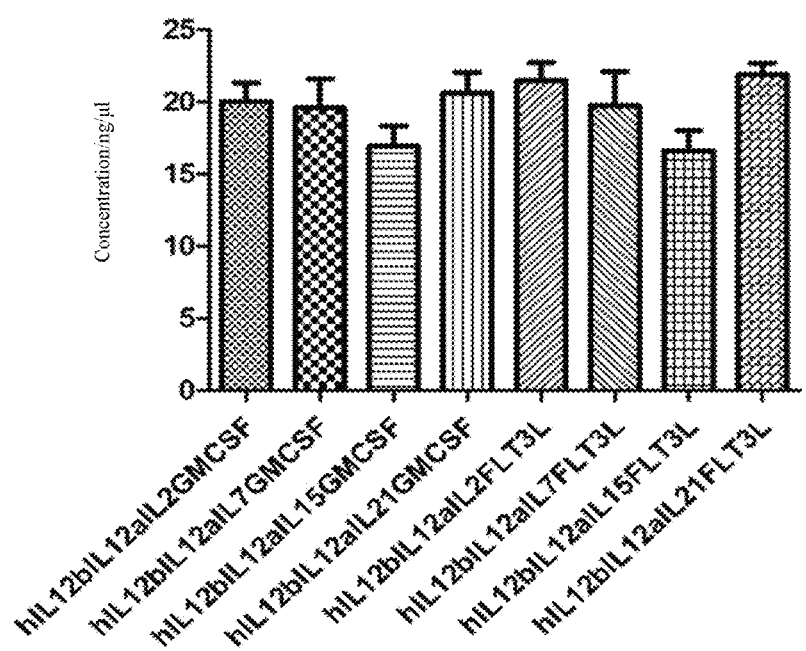
FIG. 47 show the expression levels of protein molecules according to the present application.

The constructed expression cells were plated into a 24-well plate at $5\times10^4$ per well, and cultured for 96 hours. The supernatant was collected. The expression of the protein molecule in the supernatant was detected by using a human IL12p70 ELISA kit, where the operations were conducted according to the instructions of the kit. The results showed that the cells expressing the protein molecules described in the present application were successfully constructed (as shown in FIG. 47).

The foregoing detailed description is provided by way of explanation and examples, and is not intended to limit the scope of the appended claims. Various changes of the embodiments listed in the present application until now are obvious to those of ordinary skill in the art, and should be kept within the scope of the appended claims and equivalents thereof.

SEQUENCE LISTING (118 sequences)

SEQ ID NO: 1 - protein, 469 aa, Artificial Sequence
  DiaL19
EVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSSSSGSSSSGSSSSGEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIK

SEQ ID NO: 2 - protein, 477 aa, Artificial Sequence
  DiaF8
EVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIK

SEQ ID NO: 3 - protein, 475 aa, Artificial Sequence
  DiaNHS76
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGSSSSGSSSSGQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 4 - protein, 476 aa, Artificial Sequence
  DiaNHS76F8
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 5 - protein, 472 aa, Artificial Sequence
  DiaNHS76L19
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSSSSGSSSSGSSSSGEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 6 - protein, 476 aa, Artificial Sequence
  DiaF8NHS76
EVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGSSSSGSSSSGQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIK

SEQ ID NO: 7 - protein, 473 aa, Artificial Sequence
  DiaF8L19
EVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSSSSGSSSSGSSSSGEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIK

SEQ ID NO: 8 - protein, 472 aa, Artificial Sequence
  DiaL19NHS76
EVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGSSSSGSSSSGQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIK

SEQ ID NO: 9 - protein, 473 aa, Artificial Sequence
  DiaL19F8
EVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIK

SEQ ID NO: 10 - protein, 108 aa, Artificial Sequence [sequence omitted]

SEQ ID NO: 11 - protein, 114 aa, Artificial Sequence
  L19VH
EVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTV

SEQ ID NO: 12 - protein, 108 aa, Artificial Sequence
  F8VL
EIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIK

SEQ ID NO: 13 - protein, 118 aa, Artificial Sequence
  F8VH
EVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 14 - protein, 108 aa, Artificial Sequence
  NHS76VL
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 15 - protein, 117 aa, Artificial Sequence
  NHS76VH
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSS

SEQ ID NO: 16 - protein, 193 aa, Homo sapiens
RVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSA

SEQ ID NO: 17 - protein, 313 aa, Homo sapiens
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 18 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 19 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 20 - protein, 149 aa, Homo sapiens
APTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQ

SEQ ID NO: 21 - protein, 133 aa, Homo sapiens [sequence omitted]

SEQ ID NO: 22 - protein, 133 aa, Homo sapiens
GIHVFILGCVSVGLPKTEANWIDVRYDLEKIESLIQSIHIDTTLYTDSDFHPSCKVTAMNCFLLELQVILHEYSNMTLNETVRNVLYLANSTLSSNKNVAESGCKECEELEEKTFTEFLQSFIRIVQMFINTS

SEQ ID NO: 23 - protein, 133 aa, Homo sapiens
GIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 24 - protein, 129 aa, Homo sapiens
ECHIKDKEGKAYESVLMISIDELDKMTGTDSNCPNNEPNFFRKHVCDDTKEAAFLNRAARKLKQFLKMNISEEFNVHLLTVSQGTQTLVNCTSKEEKNVKEQKKNDACFLKRLLREIKTCWNKILKGSI

SEQ ID NO: 25 - protein, 152 aa, Homo sapiens
DCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 26 - protein, 129 aa, Homo sapiens
HKSSPQGPDRLLIRLRHLIDIVEQLKIYENDLDPELLSAPQDVKGHCEHAAFACFQKAKLKPSNPGNNKTFIIDLVAQLRRRLPARRGGKKQKHIAKCPSCDSYEKRTPKEFLERLKWLLQKMIHQHLS

SEQ ID NO: 27 - protein, 133 aa, Homo sapiens [sequence omitted]

SEQ ID NO: 28 - protein, 206 aa, Homo sapiens
GTPDCYFSHSPISSNFKVKFRELTDHLLKDYPVTVAVNLQDEKHCKALWSLFLAQRWIEQLKTVAGSKMQTLLEDVNTEIHFVTSCTFQPLPECLRFVQTNISHLLKDTCTQLLALKPCIGKACQNFSRCLEVQCQPDSSTLLPPRSPIALEATELPEPRPRQLLLLLLLLLPLTLVLLAAAWGLRWQRARRRGELHPGVPLPSHP

SEQ ID NO: 29 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 30 - protein, 124 aa, Homo sapiens
APTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 31 - protein, 127 aa, Homo sapiens [sequence omitted]

SEQ ID NO: 32 - protein, 824 aa, Artificial Sequence
  mIL12bIL12aIL2GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQGGGGSGGGGSGGGGSAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 33 - protein, 804 aa, Artificial Sequence
  mIL12bIL12aIL7GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSECHIKDKEGKAYESVLMISIDELDKMTGTDSNCPNNEPNFFRKHVCDDTKEAAFLNRAARKLKQFLKMNISEEFNVHLLTVSQGTQTLVNCTSKEEKNVKEQKKNDACFLKRLLREIKTCWNKILKGSIGGGGSGGGGSGGGGSAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 34 - protein, 808 aa, Artificial Sequence
  mIL12bIL12aIL15GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSGIHVFILGCVSVGLPKTEANWIDVRYDLEKIESLIQSIHIDTTLYTDSDFHPSCKVTAMNCFLLELQVILHEYSNMTLNETVRNVLYLANSTLSSNKNVAESGCKECEELEEKTFTEFLQSFIRIVQMFINTSGGGGSGGGGSGGGGSAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 35 - protein, 804 aa, Artificial Sequence
  mIL12bIL12aIL21GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSHKSSPQGPDRLLIRLRHLIDIVEQLKIYENDLDPELLSAPQDVKGHCEHAAFACFQKAKLKPSNPGNNKTFIIDLVAQLRRRLPARRGGKKQKHIAKCPSCDSYEKRTPKEFLERLKWLLQKMIHQHLSGGGGSGGGGSGGGGSAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 36 - protein, 906 aa, Artificial Sequence
  mIL12bIL12aIL2FLT3L
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQGGGGSGGGGSGGGGSGTPDCYFSHSPISSNFKVKFRELTDHLLKDYPVTVAVNLQDEKHCKALWSLFLAQRWIEQLKTVAGSKMQTLLEDVNTEIHFVTSCTFQPLPECLRFVQTNISHLLKDTCTQLLALKPCIGKACQNFSRCLEVQCQPDSSTLLPPRSPIALEATELPEPRPRQLLLLLLLLLPLTLVLLAAAWGLRWQRARRRGELHPGVPLPSHP

SEQ ID NO: 37 - protein, 886 aa, Artificial Sequence
  mIL12bIL12aIL7FLT3L
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSECHIKDKEGKAYESVLMISIDELDKMTGTDSNCPNNEPNFFRKHVCDDTKEAAFLNRAARKLKQFLKMNISEEFNVHLLTVSQGTQTLVNCTSKEEKNVKEQKKNDACFLKRLLREIKTCWNKILKGSIGGGGSGGGGSGGGGSGTPDCYFSHSPISSNFKVKFRELTDHLLKDYPVTVAVNLQDEKHCKALWSLFLAQRWIEQLKTVAGSKMQTLLEDVNTEIHFVTSCTFQPLPECLRFVQTNISHLLKDTCTQLLALKPCIGKACQNFSRCLEVQCQPDSSTLLPPRSPIALEATELPEPRPRQLLLLLLLLLPLTLVLLAAAWGLRWQRARRRGELHPGVPLPSHP

SEQ ID NO: 38 - protein, 890 aa, Artificial Sequence
  mIL12bIL12aIL15FLT3L
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSGIHVFILGCVSVGLPKTEANWIDVRYDLEKIESLIQSIHIDTTLYTDSDFHPSCKVTAMNCFLLELQVILHEYSNMTLNETVRNVLYLANSTLSSNKNVAESGCKECEELEEKTFTEFLQSFIRIVQMFINTSGGGGSGGGGSGGGGSGTPDCYFSHSPISSNFKVKFRELTDHLLKDYPVTVAVNLQDEKHCKALWSLFLAQRWIEQLKTVAGSKMQTLLEDVNTEIHFVTSCTFQPLPECLRFVQTNISHLLKDTCTQLLALKPCIGKACQNFSRCLEVQCQPDSSTLLPPRSPIALEATELPEPRPRQLLLLLLLLLPLTLVLLAAAWGLRWQRARRRGELHPGVPLPSHP

SEQ ID NO: 39 - protein, 886 aa, Artificial Sequence
  mIL12bIL12aIL21FLT3L
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSHKSSPQGPDRLLIRLRHLIDIVEQLKIYENDLDPELLSAPQDVKGHCEHAAFACFQKAKLKPSNPGNNKTFIIDLVAQLRRRLPARRGGKKQKHIAKCPSCDSYEKRTPKEFLERLKWLLQKMIHQHLSGGGGSGGGGSGGGGSGTPDCYFSHSPISSNFKVKFRELTDHLLKDYPVTVAVNLQDEKHCKALWSLFLAQRWIEQLKTVAGSKMQTLLEDVNTEIHFVTSCTFQPLPECLRFVQTNISHLLKDTCTQLLALKPCIGKACQNFSRCLEVQCQPDSSTLLPPRSPIALEATELPEPRPRQLLLLLLLLLPLTLVLLAAAWGLRWQRARRRGELHPGVPLPSHP

SEQ ID NO: 40 - protein, 824 aa, Artificial Sequence
  mIL12bIL12aGMCSFIL2
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQKGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQ

SEQ ID NO: 41 - protein, 808 aa, Artificial Sequence
  hIL12bIL12aIL2GMCSF
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 42 - protein, 827 aa, Artificial Sequence
  hIL12bIL12aIL7GMCSF
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEHGGGGSGGGGSGGGGSAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 43 - protein, 808 aa, Artificial Sequence
  hIL12bIL12aIL15GMCSF
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 44 - protein, 808 aa, Artificial Sequence
  hIL12bIL12aIL21GMCSF
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSGGGGSGGGGSGGGGSAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 45 - protein, 890 aa, Artificial Sequence
  hIL12bIL12aIL2FLT3L
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 46 - protein, 909 aa, Artificial Sequence
  hIL12bIL12aIL7FLT3L
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEHGGGGSGGGGSGGGGSTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 47 - protein, 890 aa, Artificial Sequence
  hIL12bIL12aIL15FLT3L
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 48 - protein, 890 aa, Artificial Sequence
  hIL12bIL12aIL21FLT3L
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSGGGGSGGGGSGGGGSTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 49 - protein, 1308 aa, Artificial Sequence
  mIL12bIL12aDiaL19IL2GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSSSSGSSSSGSSSSGEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 50 - protein, 1316 aa, Artificial Sequence
  mIL12bIL12aDiaF8IL2GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 51 - protein, 1314 aa, Artificial Sequence
  mIL12bIL12aDiaNHS76IL2GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGSSSSGSSSSGQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 52 - protein, 1315 aa, Artificial Sequence
  mIL12bIL12aDiaNHS76F8IL2GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 53 - protein, 1311 aa, Artificial Sequence
  mIL12bIL12aDiaNHS76L19IL2GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSSSSGSSSSGSSSSGEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 54 - protein, 1315 aa, Artificial Sequence
  mIL12bIL12aDiaF8NHS76IL2GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGSSSSGSSSSGQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 55 - protein, 1312 aa, Artificial Sequence
  mIL12bIL12aDiaF8L19IL2GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSSSSGSSSSGSSSSGEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 56 - protein, 1311 aa, Artificial Sequence
  mIL12bIL12aDiaL19NHS76IL2GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGSSSSGSSSSGQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 57 - protein, 1312 aa, Artificial Sequence
  mIL12bIL12aDiaL19F8IL2GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 58 - protein, 1315 aa, Artificial Sequence
  mIL12bIL12aIL2DiaNHS76F8GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQGGGGSGGGGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 59 - protein, 1316 aa, Artificial Sequence
  mIL12bIL12aIL2DiaF8GMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQGGGGSGGGGSGGGGSEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 60 - protein, 1315 aa, Artificial Sequence
  mIL12bIL12aIL2GMCSFDiaNHS76F8
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQGGGGSGGGGSGGGGSAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQKSSSSGSSSSGSSSSGQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 61 - protein, 1316 aa, Artificial Sequence
  mIL12bIL12aIL2GMCSFDiaF8
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQGGGGSGGGGSGGGGSAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIK

SEQ ID NO: 62 - protein, 1292 aa, Artificial Sequence
  hIL12bIL12aDiaL19IL2GMCSF
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSSSSGSSSSGSSSSGEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSSSSGSSSSGSSSSGAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 63 - protein, 1298 aa, Artificial Sequence
  hIL12bIL12aDiaNHS76IL2GMCSF
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGSSSSGSSSSGQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSSSSGSSSSGSSSSGAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 64 - protein, 1299 aa, Artificial Sequence
  hIL12bIL12aDiaNHS76F8IL2GMCSF
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSSSSGSSSSGSSSSGAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 65 - protein, 1299 aa, Artificial Sequence
  hIL12bIL12aIL2DiaNHS76F8GMCSF
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGSSSSGSSSSGAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 66 - protein, 1300 aa, Artificial Sequence
  hIL12bIL12aIL2DiaF8GMCSF
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 67 - protein, 1292 aa, Artificial Sequence
  hIL12bIL12aDiaL19GMCSFIL2
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSSSSGSSSSGSSSSGEVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVGGSGGEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKGGGGSGGGGSGGGGSAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQESSSSGSSSSGSSSSGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 68 - protein, 1298 aa, Artificial Sequence
  hIL12bIL12aDiaNHS76GMCSFIL2
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGSSSSGSSSSGQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQESSSSGSSSSGSSSSGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 69 - protein, 1299 aa, Artificial Sequence
  hIL12bIL12aDiaNHS76F8GMCSFIL2
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQESSSSGSSSSGSSSSGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 70 - protein, 1316 aa, Artificial Sequence
  mIL12bIL12aIL2DiaNHS76F8GMCSF-Thr
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQGGGGSLVPRGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGLVPRGSSSSGAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 71 - protein, 1300 aa, Artificial Sequence
  hIL12bIL12aIL2DiaNHS76F8GMCSF-Thr
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGGGGSLVPRGSGGGGSQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSGGSGGEIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIKSSSSGSSSSGSSSSGEVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSSGGSGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLSSSSGLVPRGSSSSGAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 72 - protein, 357 aa, Artificial Sequence
  First strand of a double-stranded fusion protein mIL12aIL2
RVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQ

SEQ ID NO: 73 - DNA, 2472 bp, Artificial Sequence
  Encoding mIL12bIL12aIL2GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaaggcggagggggttcaggtgggggcgggagcggaggtggcggatcggcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 74 - DNA, 2412 bp, Artificial Sequence
  Encoding mIL12bIL12aIL7GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgagtgccacattaaagacaaagaaggtaaagcatatgagagtgtactgatgatcagcatcgatgaattggacaaaatgacaggaactgatagtaattgcccgaataatgaaccaaacttttttagaaaacatgtatgtgatgatacaaaggaagctgcttttctaaatcgtgctgctcgcaagttgaagcaatttcttaaaatgaatatcagtgaagaattcaatgtccacttactaacagtatcacaaggcacacaaacactggtgaactgcacaagtaaggaagaaaaaaacgtaaaggaacagaaaaagaatgatgcatgtttcctaaagagactactgagagaaataaaaacttgttggaataaaattttgaagggcagtataggcggagggggttcaggtgggggcgggagcggaggtggcggatcggcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 75 - DNA, 2424 bp, Artificial Sequence
  Encoding mIL12bIL12aIL15GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcggcattcatgtcttcattttgggctgtgtcagtgtaggtctccctaaaacagaggccaactggatagatgtaagatatgacctggagaaaattgaaagccttattcaatctattcatattgacaccactttatacactgacagtgactttcatcccagttgcaaagttactgcaatgaactgctttctcctggaattgcaggttattttacatgagtacagtaacatgactcttaatgaaacagtaagaaacgtgctctaccttgcaaacagcactctgtcttctaacaagaatgtagcagaatctggctgcaaggaatgtgaggagctggaggagaaaaccttcacagagtttttgcaaagctttatacgcattgtccaaatgttcatcaacacgtccggcggagggggttcaggtgggggcgggagcggaggtggcggatcggcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 76 - DNA, 2412 bp, Artificial Sequence
  Encoding mIL12bIL12aIL21GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagccataaatcaagcccccaagggccagatcgcctcctgattagacttcgtcaccttattgacattgttgaacagctgaaaatctatgaaaatgacttggatcctgaacttctatcagctccacaagatgtaaaggggcactgtgagcatgcagcttttgcctgttttcagaaggccaaactcaagccatcaaaccctggaaacaataagacattcatcattgacctcgtggcccagctcaggaggaggctgcctgccaggaggggaggaaagaaacagaagcacatagctaaatgcccttcctgtgattcgtatgagaaaaggacacccaaagaattcctagaaagactaaaatggctccttcaaaagatgattcatcagcatctctccggcggagggggttcaggtgggggcgggagcggaggtggcggatcggcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 77 - DNA, 2718 bp, Artificial Sequence
  Encoding mIL12bIL12aIL2FLT3L
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaaggcggagggggttcaggtgggggcgggagcggaggtggcggatcggggacacctgactgttacttcagccacagtcccatctcctccaacttcaaagtgaagtttagagagttgactgaccacctgcttaaagattacccagtcactgtggccgtcaatcttcaggacgagaagcactgcaaggccttgtggagcctcttcctagcccagcgctggatagagcaactgaagactgtggcagggtctaagatgcaaacgcttctggaggacgtcaacaccgagatacattttgtcacctcatgtaccttccagcccctaccagaatgtctgcgattcgtccagaccaacatctcccacctcctgaaggacacctgcacacagctgcttgctctgaagccctgtatcgggaaggcctgccagaatttctctcggtgcctggaggtgcagtgccagccggactcctccaccctgctgcccccaaggagtcccatagccctagaagccacggagctcccagagcctcggcccaggcagctgttgctcctgctgctgctgctgctgcctctcacactggtgctgctggcagccgcctggggccttcgctggcaaagggcaagaaggaggggggagctccaccctggggtgcccctcccctcccatccc

SEQ ID NO: 78 - DNA, 2658 bp, Artificial Sequence
  Encoding mIL12bIL12aIL7FLT3L
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgagtgccacattaaagacaaagaaggtaaagcatatgagagtgtactgatgatcagcatcgatgaattggacaaaatgacaggaactgatagtaattgcccgaataatgaaccaaacttttttagaaaacatgtatgtgatgatacaaaggaagctgcttttctaaatcgtgctgctcgcaagttgaagcaatttcttaaaatgaatatcagtgaagaattcaatgtccacttactaacagtatcacaaggcacacaaacactggtgaactgcacaagtaaggaagaaaaaaacgtaaaggaacagaaaaagaatgatgcatgtttcctaaagagactactgagagaaataaaaacttgttggaataaaattttgaagggcagtataggcggagggggttcaggtgggggcgggagcggaggtggcggatcggggacacctgactgttacttcagccacagtcccatctcctccaacttcaaagtgaagtttagagagttgactgaccacctgcttaaagattacccagtcactgtggccgtcaatcttcaggacgagaagcactgcaaggccttgtggagcctcttcctagcccagcgctggatagagcaactgaagactgtggcagggtctaagatgcaaacgcttctggaggacgtcaacaccgagatacattttgtcacctcatgtaccttccagcccctaccagaatgtctgcgattcgtccagaccaacatctcccacctcctgaaggacacctgcacacagctgcttgctctgaagccctgtatcgggaaggcctgccagaatttctctcggtgcctggaggtgcagtgccagccggactcctccaccctgctgcccccaaggagtcccatagccctagaagccacggagctcccagagcctcggcccaggcagctgttgctcctgctgctgctgctgctgcctctcacactggtgctgctggcagccgcctggggccttcgctggcaaagggcaagaaggaggggggagctccaccctggggtgcccctcccctcccatccc

SEQ ID NO: 79 - DNA, 2670 bp, Artificial Sequence
  Encoding mIL12bIL12aIL15FLT3L
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcggcattcatgtcttcattttgggctgtgtcagtgtaggtctccctaaaacagaggccaactggatagatgtaagatatgacctggagaaaattgaaagccttattcaatctattcatattgacaccactttatacactgacagtgactttcatcccagttgcaaagttactgcaatgaactgctttctcctggaattgcaggttattttacatgagtacagtaacatgactcttaatgaaacagtaagaaacgtgctctaccttgcaaacagcactctgtcttctaacaagaatgtagcagaatctggctgcaaggaatgtgaggagctggaggagaaaaccttcacagagtttttgcaaagctttatacgcattgtccaaatgttcatcaacacgtccggcggagggggttcaggtgggggcgggagcggaggtggcggatcggggacacctgactgttacttcagccacagtcccatctcctccaacttcaaagtgaagtttagagagttgactgaccacctgcttaaagattacccagtcactgtggccgtcaatcttcaggacgagaagcactgcaaggccttgtggagcctcttcctagcccagcgctggatagagcaactgaagactgtggcagggtctaagatgcaaacgcttctggaggacgtcaacaccgagatacattttgtcacctcatgtaccttccagcccctaccagaatgtctgcgattcgtccagaccaacatctcccacctcctgaaggacacctgcacacagctgcttgctctgaagccctgtatcgggaaggcctgccagaatttctctcggtgcctggaggtgcagtgccagccggactcctccaccctgctgcccccaaggagtcccatagccctagaagccacggagctcccagagcctcggcccaggcagctgttgctcctgctgctgctgctgctgcctctcacactggtgctgctggcagccgcctggggccttcgctggcaaagggcaagaaggaggggggagctccaccctggggtgcccctcccctcccatccc

SEQ ID NO: 80 - DNA, 2658 bp, Artificial Sequence
  Encoding mIL12bIL12aIL21FLT3L
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagccataaatcaagcccccaagggccagatcgcctcctgattagacttcgtcaccttattgacattgttgaacagctgaaaatctatgaaaatgacttggatcctgaacttctatcagctccacaagatgtaaaggggcactgtgagcatgcagcttttgcctgttttcagaaggccaaactcaagccatcaaaccctggaaacaataagacattcatcattgacctcgtggcccagctcaggaggaggctgcctgccaggaggggaggaaagaaacagaagcacatagctaaatgcccttcctgtgattcgtatgagaaaaggacacccaaagaattcctagaaagactaaaatggctccttcaaaagatgattcatcagcatctctccggcggagggggttcaggtgggggcgggagcggaggtggcggatcggggacacctgactgttacttcagccacagtcccatctcctccaacttcaaagtgaagtttagagagttgactgaccacctgcttaaagattacccagtcactgtggccgtcaatcttcaggacgagaagcactgcaaggccttgtggagcctcttcctagcccagcgctggatagagcaactgaagactgtggcagggtctaagatgcaaacgcttctggaggacgtcaacaccgagatacattttgtcacctcatgtaccttccagcccctaccagaatgtctgcgattcgtccagaccaacatctcccacctcctgaaggacacctgcacacagctgcttgctctgaagccctgtatcgggaaggcctgccagaatttctctcggtgcctggaggtgcagtgccagccggactcctccaccctgctgcccccaaggagtcccatagccctagaagccacggagctcccagagcctcggcccaggcagctgttgctcctgctgctgctgctgctgcctctcacactggtgctgctggcagccgcctggggccttcgctggcaaagggcaagaaggaggggggagctccaccctggggtgcccctcccctcccatccc

SEQ ID NO: 81 - DNA, 2472 bp, Artificial Sequence
  Encoding mIL12bIL12aGMCSFIL2
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaaggcggagggggttcaggtgggggcgggagcggaggtggcggatcggcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaa

SEQ ID NO: 82 - DNA, 2424 bp, Artificial Sequence
  Encoding hIL12bIL12aIL2GMCSF
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcggagggggttcaggtgggggcgggagcggaggtggcggatcggcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggag

SEQ ID NO: 83 - DNA, 2481 bp, Artificial Sequence
  Encoding hIL12bIL12aIL7GMCSF
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacacggcggagggggttcaggtgggggcgggagcggaggtggcggatcggcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggag

SEQ ID NO: 84 - DNA, 2424 bp, Artificial Sequence
  Encoding hIL12bIL12aIL15GMCSF
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggcggagggggttcaggtgggggcgggagcggaggtggcggatcggcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggag

SEQ ID NO: 85 - DNA, 2424 bp, Artificial Sequence
  Encoding hIL12bIL12aIL21GMCSF
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagccaaggtcaagatcgccacatgattagaatgcgtcaacttatagatattgttgatcagctgaaaaattatgtgaatgacttggtccctgaatttctgccagctccagaagatgtagagacaaactgtgagtggtcagctttttcctgctttcagaaggcccaactaaagtcagcaaatacaggaaacaatgaaaggataatcaatgtatcaattaaaaagctgaagaggaaaccaccttccacaaatgcagggagaagacagaaacacagactaacatgcccttcatgtgattcttatgagaaaaaaccacccaaagaattcctagaaagattcaaatcacttctccaaaagatgattcatcagcatctgtcctctagaacacacggaagtgaagattccggcggagggggttcaggtgggggcgggagcggaggtggcggatcggcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggag

SEQ ID NO: 86 - DNA, 2670 bp, Artificial Sequence
  Encoding hIL12bIL12aIL2FLT3L
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcggagggggttcaggtgggggcgggagcggaggtggcggatcgacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcac

SEQ ID NO: 87 - DNA, 2727 bp, Artificial Sequence
  Encoding hIL12bIL12aIL7FLT3L
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacacggcggagggggttcaggtgggggcgggagcggaggtggcggatcgacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcac

SEQ ID NO: 88 - DNA, 2670 bp, Artificial Sequence
  Encoding hIL12bIL12aIL15FLT3L
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggcggagggggttcaggtgggggcgggagcggaggtggcggatcgacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcac

SEQ ID NO: 89 - DNA, 2670 bp, Artificial Sequence
  Encoding hIL12bIL12aIL21FLT3L
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagccaaggtcaagatcgccacatgattagaatgcgtcaacttatagatattgttgatcagctgaaaaattatgtgaatgacttggtccctgaatttctgccagctccagaagatgtagagacaaactgtgagtggtcagctttttcctgctttcagaaggcccaactaaagtcagcaaatacaggaaacaatgaaaggataatcaatgtatcaattaaaaagctgaagaggaaaccaccttccacaaatgcagggagaagacagaaacacagactaacatgcccttcatgtgattcttatgagaaaaaaccacccaaagaattcctagaaagattcaaatcacttctccaaaagatgattcatcagcatctgtcctctagaacacacggaagtgaagattccggcggagggggttcaggtgggggcgggagcggaggtggcggatcgacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcac

SEQ ID NO: 90 - DNA, 3924 bp, Artificial Sequence
  Encoding mIL12bIL12aDiaL19IL2GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgaggtgcagctgttggagtctgggggaggcttggtacagcctggggggtccctgagactctcctgtgcagcctctggattcacctttagcagtttttcgatgagctgggtccgccaggctccagggaaggggctggagtgggtctcatctattagtggtagttcgggtaccacatactacgcagactccgtgaagggccggttcaccatctccagagacaattccaagaacacgctgtatctgcaaatgaacagcctgagagccgaagacacggccgtatattactgtgcgaaaccgtttccgtattttgactactggggccagggaaccctggtcaccgtcggcggtagcggaggggaaattgtgttgacgcagtctccaggcaccctgtctttgtctccaggggaaagagccaccctctcctgcagggccagtcagagtgttagcagcagctttttagcctggtaccagcagaaacctggccaggctcccaggctcctcatctattatgcatccagcagggccactggcatcccagacaggttcagtggcagtgggtctgggacagacttcactctcaccatcagcagactggagcctgaagattttgcagtgtattactgtcagcagacgggtcgtattccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcagtttttcgatgagctgggtccgccaggctccagggaaggggctggagtgggtctcatctattagtggtagttcgggtaccacatactacgcagactccgtgaagggccggttcaccatctccagagacaattccaagaacacgctgtatctgcaaatgaacagcctgagagccgaagacacggccgtatattactgtgcgaaaccgtttccgtattttgactactggggccagggaaccctggtcaccgtcggcggtagcggaggggaaattgtgttgacgcagtctccaggcaccctgtctttgtctccaggggaaagagccaccctctcctgcagggccagtcagagtgttagcagcagctttttagcctggtaccagcagaaacctggccaggctcccaggctcctcatctattatgcatccagcagggccactggcatcccagacaggttcagtggcagtgggtctgggacagacttcactctcaccatcagcagactggagcctgaagattttgcagtgtattactgtcagcagacgggtcgtattccgccgacgttcggccaagggaccaaggtggaaatcaaaggcggagggggttcaggtgggggcgggagcggaggtggcggatcggcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaatcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 91 - DNA, 3948 bp, Artificial Sequence
  Encoding mIL12bIL12aDiaF8IL2GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaaggcggagggggttcaggtgggggcgggagcggaggtggcggatcggcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaatcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 92 - DNA, 3942 bp, Artificial Sequence
  Encoding mIL12bIL12aDiaNHS76IL2GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagccaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgtcttcaagtagcggttcaagttcctctggatcgtcaagctctggtcaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgggcggagggggttcaggtgggggcgggagcggaggtggcggatcggcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaatcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 93 - DNA, 3945 bp, Artificial Sequence
  Encoding mIL12bIL12aDiaNHS76F8IL2GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagccaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgggcggagggggttcaggtgggggcgggagcggaggtggcggatcggcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaatcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 94 - DNA, 3933 bp, Artificial Sequence
  Encoding mIL12bIL12aDiaNHS76L19IL2GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagccaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcagcagctttttagcctggtaccagcagaaacctggccaggctcccaggctcctcatctattatgcatccagcagggccactggcatcccagacaggttcagtggcagtgggtctgggacagacttcactctcaccatcagcagactggagcctgaagattttgcagtgtattactgtcagcagacgggtcgtattccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcagtttttcgatgagctgggtccgccaggctccagggaaggggctggagtgggtctcatctattagtggtagttcgggtaccacatactacgcagactccgtgaagggccggttcaccatctccagagacaattccaagaacacgctgtatctgcaaatgaacagcctgagagccgaagacacggccgtatattactgtgcgaaaccgtttccgtattttgactactggggccagggaaccctggtcaccgtcggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgggcggagggggttcaggtgggggcgggagcggaggtggcggatcggcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaatcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 95 - DNA, 3945 bp, Artificial Sequence
  Encoding mIL12bIL12aDiaF8NHS76IL2GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgtcttcaagtagcggttcaagttcctctggatcgtcaagctctggtcaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaaggcggagggggttcaggtgggggcgggagcggaggtggcggatcggcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaatcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 96 - DNA, 3936 bp, Artificial Sequence
  Encoding mIL12bIL12aDiaF8L19IL2GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggaggggaaattgtgttgacgcagtctccaggcaccctgtctttgtctccaggggaaagagccaccctctcctgcagggccagtcagagtgttagcagcagctttttagcctggtaccagcagaaacctggccaggctcccaggctcctcatctattatgcatccagcagggccactggcatcccagacaggttcagtggcagtgggtctgggacagacttcactctcaccatcagcagactggagcctgaagattttgcagtgtattactgtcagcagacgggtcgtattccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcagtttttcgatgagctgggtccgccaggctccagggaaggggctggagtgggtctcatctattagtggtagttcgggtaccacatactacgcagactccgtgaagggccggttcaccatctccagagacaattccaagaacacgctgtatctgcaaatgaacagcctgagagccgaagacacggccgtatattactgtgcgaaaccgtttccgtattttgactactggggccagggaaccctggtcaccgtcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaaggcggagggggttcaggtgggggcgggagcggaggtggcggatcggcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaatcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 97 - DNA, 3933 bp, Artificial Sequence
  Encoding mIL12bIL12aDiaL19NHS76IL2GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgaggtgcagctgttggagtctgggggaggcttggtacagcctggggggtccctgagactctcctgtgcagcctctggattcacctttagcagtttttcgatgagctgggtccgccaggctccagggaaggggctggagtgggtctcatctattagtggtagttcgggtaccacatactacgcagactccgtgaagggccggttcaccatctccagagacaattccaagaacacgctgtatctgcaaatgaacagcctgagagccgaagacacggccgtatattactgtgcgaaaccgtttccgtattttgactactggggccagggaaccctggtcaccgtcggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgtcttcaagtagcggttcaagttcctctggatcgtcaagctctggtcaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcagcagctttttagcctggtaccagcagaaacctggccaggctcccaggctcctcatctattatgcatccagcagggccactggcatcccagacaggttcagtggcagtgggtctgggacagacttcactctcaccatcagcagactggagcctgaagattttgcagtgtattactgtcagcagacgggtcgtattccgccgacgttcggccaagggaccaaggtggaaatcaaaggcggagggggttcaggtgggggcgggagcggaggtggcggatcggcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaatcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 98 - DNA, 3936 bp, Artificial Sequence
  Encoding mIL12bIL12aDiaL19F8IL2GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgaggtgcagctgttggagtctgggggaggcttggtacagcctggggggtccctgagactctcctgtgcagcctctggattcacctttagcagtttttcgatgagctgggtccgccaggctccagggaaggggctggagtgggtctcatctattagtggtagttcgggtaccacatactacgcagactccgtgaagggccggttcaccatctccagagacaattccaagaacacgctgtatctgcaaatgaacagcctgagagccgaagacacggccgtatattactgtgcgaaaccgtttccgtattttgactactggggccagggaaccctggtcaccgtcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggaggggaaattgtgttgacgcagtctccaggcaccctgtctttgtctccaggggaaagagccaccctctcctgcagggccagtcagagtgttagcagcagctttttagcctggtaccagcagaaacctggccaggctcccaggctcctcatctattatgcatccagcagggccactggcatcccagacaggttcagtggcagtgggtctgggacagacttcactctcaccatcagcagactggagcctgaagattttgcagtgtattactgtcagcagacgggtcgtattccgccgacgttcggccaagggaccaaggtggaaatcaaaggcggagggggttcaggtgggggcgggagcggaggtggcggatcggcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaatcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 99 - DNA, 3945 bp, Artificial Sequence
  Encoding mIL12bIL12aIL2DiaNHS76F8GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaaggcggagggggttcaggtgggggcgggagcggaggtggcggatcgcaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgtcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 100 - DNA, 3948 bp, Artificial Sequence
  Encoding mIL12bIL12aIL2DiaF8GMCSF
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaaggcggagggggttcaggtgggggcgggagcggaggtggcggatcggaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcaagttcctctggtagttcatctagcggtagttcttcatcgggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 101 - DNA, 3945 bp, Artificial Sequence
  Encoding mIL12bIL12aIL2GMCSFDiaNHS76F8
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaaggcggagggggttcaggtgggggcgggagcggaggtggcggatcggcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaatcaagttcctctggtagttcatctagcggtagttcttcatcgggtcaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctg

SEQ ID NO: 102 - DNA, 3948 bp, Artificial Sequence
  Encoding mIL12bIL12aIL2GMCSFDiaF8
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaaggcggagggggttcaggtgggggcgggagcggaggtggcggatcggcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaatcaagttcctctggtagttcatctagcggtagttcttcatcgggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaa

SEQ ID NO: 103 - DNA, 3876 bp, Artificial Sequence
  Encoding hIL12bIL12aDiaL19IL2GMCSF
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcgaggtgcagctgttggagtctgggggaggcttggtacagcctggggggtccctgagactctcctgtgcagcctctggattcacctttagcagtttttcgatgagctgggtccgccaggctccagggaaggggctggagtgggtctcatctattagtggtagttcgggtaccacatactacgcagactccgtgaagggccggttcaccatctccagagacaattccaagaacacgctgtatctgcaaatgaacagcctgagagccgaagacacggccgtatattactgtgcgaaaccgtttccgtattttgactactggggccagggaaccctggtcaccgtcggcggtagcggaggggaaattgtgttgacgcagtctccaggcaccctgtctttgtctccaggggaaagagccaccctctcctgcagggccagtcagagtgttagcagcagctttttagcctggtaccagcagaaacctggccaggctcccaggctcctcatctattatgcatccagcagggccactggcatcccagacaggttcagtggcagtgggtctgggacagacttcactctcaccatcagcagactggagcctgaagattttgcagtgtattactgtcagcagacgggtcgtattccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcagtttttcgatgagctgggtccgccaggctccagggaaggggctggagtgggtctcatctattagtggtagttcgggtaccacatactacgcagactccgtgaagggccggttcaccatctccagagacaattccaagaacacgctgtatctgcaaatgaacagcctgagagccgaagacacggccgtatattactgtgcgaaaccgtttccgtattttgactactggggccagggaaccctggtcaccgtcggcggtagcggaggggaaattgtgttgacgcagtctccaggcaccctgtctttgtctccaggggaaagagccaccctctcctgcagggccagtcagagtgttagcagcagctttttagcctggtaccagcagaaacctggccaggctcccaggctcctcatctattatgcatccagcagggccactggcatcccagacaggttcagtggcagtgggtctgggacagacttcactctcaccatcagcagactggagcctgaagattttgcagtgtattactgtcagcagacgggtcgtattccgccgacgttcggccaagggaccaaggtggaaatcaaaggcggagggggttcaggtgggggcgggagcggaggtggcggatcggcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttcaagttcctctggtagttcatctagcggtagttcttcatcgggtgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggag

SEQ ID NO: 104 - DNA, 3894 bp, Artificial Sequence
  Encoding hIL12bIL12aDiaNHS76IL2GMCSF
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagccaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgtcttcaagtagcggttcaagttcctctggatcgtcaagctctggtcaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgggcggagggggttcaggtgggggcgggagcggaggtggcggatcggcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttcaagttcctctggtagttcatctagcggtagttcttcatcgggtgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggag

SEQ ID NO: 105 - DNA, 3897 bp, Artificial Sequence
  Encoding hIL12bIL12aDiaNHS76F8IL2GMCSF
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagccaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgggcggagggggttcaggtgggggcgggagcggaggtggcggatcggcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttcaagttcctctggtagttcatctagcggtagttcttcatcgggtgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggag

SEQ ID NO: 106 - DNA, 3897 bp, Artificial Sequence
  Encoding hIL12bIL12aIL2DiaNHS76F8GMCSF
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcggagggggttcaggtgggggcgggagcggaggtggcggatcgcaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgtcaagttcctctggtagttcatctagcggtagttcttcatcgggtgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggag

SEQ ID NO: 107 - DNA, 3900 bp, Artificial Sequence
  Encoding hIL12bIL12aIL2DiaF8GMCSF
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcggagggggttcaggtgggggcgggagcggaggtggcggatcggaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcaagttcctctggtagttcatctagcggtagttcttcatcgggtgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggag

SEQ ID NO: 108 - DNA, 3876 bp, Artificial Sequence
  Encoding hIL12bIL12aDiaL19GMCSFIL2
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcgaggtgcagctgttggagtctgggggaggcttggtacagcctggggggtccctgagactctcctgtgcagcctctggattcacctttagcagtttttcgatgagctgggtccgccaggctccagggaaggggctggagtgggtctcatctattagtggtagttcgggtaccacatactacgcagactccgtgaagggccggttcaccatctccagagacaattccaagaacacgctgtatctgcaaatgaacagcctgagagccgaagacacggccgtatattactgtgcgaaaccgtttccgtattttgactactggggccagggaaccctggtcaccgtcggcggtagcggaggggaaattgtgttgacgcagtctccaggcaccctgtctttgtctccaggggaaagagccaccctctcctgcagggccagtcagagtgttagcagcagctttttagcctggtaccagcagaaacctggccaggctcccaggctcctcatctattatgcatccagcagggccactggcatcccagacaggttcagtggcagtgggtctgggacagacttcactctcaccatcagcagactggagcctgaagattttgcagtgtattactgtcagcagacgggtcgtattccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcagtttttcgatgagctgggtccgccaggctccagggaaggggctggagtgggtctcatctattagtggtagttcgggtaccacatactacgcagactccgtgaagggccggttcaccatctccagagacaattccaagaacacgctgtatctgcaaatgaacagcctgagagccgaagacacggccgtatattactgtgcgaaaccgtttccgtattttgactactggggccagggaaccctggtcaccgtcggcggtagcggaggggaaattgtgttgacgcagtctccaggcaccctgtctttgtctccaggggaaagagccaccctctcctgcagggccagtcagagtgttagcagcagctttttagcctggtaccagcagaaacctggccaggctcccaggctcctcatctattatgcatccagcagggccactggcatcccagacaggttcagtggcagtgggtctgggacagacttcactctcaccatcagcagactggagcctgaagattttgcagtgtattactgtcagcagacgggtcgtattccgccgacgttcggccaagggaccaaggtggaaatcaaaggcggagggggttcaggtgggggcgggagcggaggtggcggatcggcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtcaagttcctctggtagttcatctagcggtagttcttcatcgggtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 109 - DNA, 3894 bp, Artificial Sequence
  Encoding hIL12bIL12aDiaNHS76GMCSFIL2
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagccaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgtcttcaagtagcggttcaagttcctctggatcgtcaagctctggtcaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgggcggagggggttcaggtgggggcgggagcggaggtggcggatcggcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtcaagttcctctggtagttcatctagcggtagttcttcatcgggtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 110 - DNA, 3897 bp, Artificial Sequence
  Encoding hIL12bIL12aDiaNHS76F8GMCSFIL2
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagccaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgggcggagggggttcaggtgggggcgggagcggaggtggcggatcggcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtcaagttcctctggtagttcatctagcggtagttcttcatcgggtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 111 - DNA, 3948 bp, Artificial Sequence
  Encoding mIL12bIL12aIL2DiaNHS76F8GMCSF-Thr
atgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaaggcggagggggttcactcgtcccaagaggaagtggaggtggcggatcgcaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgtcttcaagtagcggtctcgtcccaagaggaagttcaagctctggtgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaa

SEQ ID NO: 112 - DNA, 3900 bp, Artificial Sequence
  Encoding hIL12bIL12aIL2DiaNHS76F8GMCSF-Thr
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggaggcggtggaagtggcggtggaggctctggaggtggcggaagcagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttccggtggaggaggttctggaggcggtggaagtggtggcggaggtagcgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcggagggggttcactcgtcccaagaggaagtggaggtggcggatcgcaggtgcagctgcaggagagcggccccggcctggtgaagcccagcgagaccctgagcctgacctgcgccgtgagcggctacagcatcagcagcggctactactggggctggatcaggcagccccccggcaagggcctggagtggatcggcagcatctaccacagcggcagcacctactacaaccccagcctgaagagcagggtgaccatcagcgtggacaccagcaagaaccagttcagcctgaagctgagcagcgtgaccgccgccgacaccgccgtgtactactgcgccaggggcaagtggagcaagttcgactactggggccagggcaccctggtgaccgtgagcagcggcggtagcggaggggaaattgtgttgacgcagtctccaggcaccctgtctttgtctccaggggaaagagccaccctctcctgcagggccagtcagagtgttagcatgccgtttttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagatgcgtggtcggccgccgacgttcggccaagggaccaaggtggaaatcaaatcttcaagtagcggttcaagttcctctggatcgtcaagctctggtgaggtgcagctgttggagtctgggggaggcttggtacagcctggggggtccctgagactctcctgtgcagcctctggattcacctttagcctgtttacgatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaagtactcatttgtatctttttgactactggggccagggaaccctggtcaccgtctccagtggcggtagcggagggagcagcgagctgacccaggaccccgccgtgagcgtggccctgggccagaccgtgaggatcacctgccagggcgacagcctgaggagctactacgccagctggtaccagcagaagcccggccaggcccccgtgctggtgatctacggcaagaacaacaggcccagcggcatccccgacaggttcagcggcagcagcagcggcaacaccgccagcctgaccatcaccggcgcccaggccgaggacgaggccgactactactgcaacagcagggacagcagcggcaaccacgtggtgttcggcggcggcaccaagctgaccgtgctgtcttcaagtagcggtctcgtcccaagaggaagttcaagctctggtgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggag

SEQ ID NO: 113 - DNA, 2616 bp, Artificial Sequence
  Encoding double chains mIL12aIL2-IL12bGMCSF
atgtgtcaatcacgctacctcctctttttggccacccttgccctcctaaaccacctcagtttggccagggtcattccagtctctggacctgccaggtgtcttagccagtcccgaaacctgctgaagaccacagatgacatggtgaagacggccagagaaaaactgaaacattattcctgcactgctgaagacatcgatcatgaagacatcacacgggaccaaaccagcacattgaagacctgtttaccactggaactacacaagaacgagagttgcctggctactagagagacttcttccacaacaagagggagctgcctgcccccacagaagacgtctttgatgatgaccctgtgccttggtagcatctatgaggacttgaagatgtaccagacagagttccaggccatcaacgcagcacttcagaatcacaaccatcagcagatcattctagacaagggcatgctggtggccatcgatgagctgatgcagtctctgaatcataatggcgagactctgcgccagaaacctcctgtgggagaagcagacccttacagagtgaaaatgaagctctgcatcctgcttcacgccttcagcacccgcgtcgtgaccatcaacagggtgatgggctatctgagctccgccggtggaggaggttctggaggcggtggaagtggtggcggaggtagcgcacccacttcaagctccacttcaagctctacagcggaagcacagcagcagcagcagcagcagcagcagcagcagcagcacctggagcagctgttgatggacctacaggagctcctgagcaggatggagaattacaggaacctgaaactccccaggatgctcaccttcaaattttacttgcccaagcaggccacagaattgaaagatcttcagtgcctagaagatgaacttggacctctgcggcatgttctggatttgactcaaagcaaaagctttcaattggaagatgctgagaatttcatcagcaatatcagagtaactgttgtaaaactaaagggctctgacaacacatttgagtgccaattcgatgatgagtcagcaactgtggtggactttctgaggagatggatagccttctgtcaaagcatcatctcaacaagccctcaagagggcagaggaagtcttctaacatgcggtgacgtggaggagaatcccggccctatgtgtcctcagaagctaaccatctcctggtttgccatcgttttgctggtgtctccactcatggccatgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcgtgcagcaagtgggcatgtgttccctgcagggtccgatccggaggcggtggaagtggcggtggaggctctggaggtggcggaagcgcacccacccgctcacccatcactgtcacccggccttggaagcatgtagaggccatcaaagaagccctgaacctcctggatgacatgcctgtcacgttgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccaggccaaaaatga

SEQ ID NO: 114 - protein, 15 aa, Artificial Sequence
  linker
GGGGSGGGGSGGGGS

SEQ ID NO: 115 - protein, 16 aa, Artificial Sequence
  linker
GGGGSLVPRGSGGGGS

SEQ ID NO: 116 - protein, 15 aa, Artificial Sequence
  linker
SSSSGSSSSGSSSSG

SEQ ID NO: 117 - protein, 15 aa, Artificial Sequence
  linker
SSSSGLVPRGSSSSG

SEQ ID NO: 118 - protein, 452 aa, Artificial Sequence
  The second strand of a double-stranded fusion protein IL12bGMCSF
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

The invention claimed is:

1. A protein molecule, comprising interleukin 12a (IL12a), interleukin 12b (IL12b), a first factor and a second factor,
wherein the IL12a, the IL12b, the first factor and the second factor are located in the same polypeptide chain,
wherein:
a) the first factor is interleukin-2 (IL2), and the second factor is GMCSF (granulocyte macrophage colony stimulating factor);
b) the first factor is interleukin-7 (IL7), and the second factor is GMCSF;
c) the first factor is interleukin-15 (IL15), and the second factor is GMCSF;
d) the first factor is interleukin-21 (IL21), and the second factor is GMCSF;
e) the first factor is IL2, and the second factor is FMS-associated tyrosine kinase 3 ligand (FLT3L);
f) the first factor is IL7, and the second factor is FLT3L;
g) the first factor is IL15, and the second factor is FLT3L;
h) the first factor is IL21, and the second factor is FLT3L;
i) the first factor is GMCSF, and the second factor is IL2;
j) the first factor is GMCSF, and the second factor is IL7;
k) the first factor is GMCSF, and the second factor is IL15;
l) the first factor is GMCSF, and the second factor is IL21;
m) the first factor is FLT3L, and the second factor is IL2;
n) the first factor is FLT3L, and the second factor is IL7;
o) the first factor is FLT3L, and the second factor is IL15; or
p) the first factor is FLT3L, and the second factor is IL21;
wherein the protein molecule sequentially comprises said IL12b, said IL12a, said first factor and said second factor from the N-terminal to the C-terminal, or sequentially comprises said IL12b, said IL12a, said second factor and said first factor from the N-terminal to the C-terminal; and
wherein said IL12b, said IL12a, said first factor and said second factor are each linked to one another via a linker as set forth in any one of SEQ ID NO: 114 and SEQ ID NO:116.

2. The protein molecule according to claim 1, which comprises any one selected from the amino acid sequences as set forth in the group consisting of SEQ ID NOs: 32-48.

3. The protein molecule according to claim 1, which further comprises a targeting moiety, wherein said targeting moiety, said IL12b, said IL12a, said first factor and said second factor are located in the same polypeptide chain, and wherein the protein molecule comprises any one selected from the amino acid sequences as set forth in the group consisting of SEQ ID NOs: 49-71.

4. The protein molecule according to claim 1, wherein the first factor is IL2, and the second factor is GMCSF (granulocyte macrophage colony stimulating factor).

5. The protein molecule according to claim 1, wherein the first factor is IL7, and the second factor is GMCSF.

6. The protein molecule according to claim 1, wherein the first factor is IL15, and the second factor is GMCSF.

7. The protein molecule according to claim 1, wherein the first factor is IL21, and the second factor is GMCSF.

8. The protein molecule according to claim 1, wherein the first factor is IL2, and the second factor is FLT3L (FMS-associated tyrosine kinase 3 ligand).

9. The protein molecule according to claim 1, wherein the first factor is IL7, and the second factor is FLT3L.

10. The protein molecule according to claim 1, wherein the first factor is IL15, and the second factor is FLT3L.

11. The protein molecule according to claim 1, wherein the first factor is IL21, and the second factor is FLT3L.

12. The protein molecule according to claim 1, wherein the first factor is GMCSF, and the second factor is IL2.

13. The protein molecule according to claim 1, wherein the first factor is GMCSF, and the second factor is IL7.

14. The protein molecule according to claim 1, wherein the first factor is GMCSF, and the second factor is IL15.

15. The protein molecule according to claim 1, wherein the first factor is GMCSF, and the second factor is IL21.

16. The protein molecule according to claim 1, wherein the first factor is FLT3L, and the second factor is IL2.

17. The protein molecule according to claim 1, wherein the first factor is FLT3L, and the second factor is IL7.

18. The protein molecule according to claim 1, wherein the first factor is FLT3L, and the second factor is IL15.

19. The protein molecule according to claim 1, wherein the first factor is FLT3L, and the second factor is IL21.

20. An isolated cell expressing the protein molecule according to claim 1.

\* \* \* \* \*